US011602544B2

(12) United States Patent
Oh et al.

(10) Patent No.: US 11,602,544 B2
(45) Date of Patent: Mar. 14, 2023

(54) COMPOSITIONS AND METHODS FOR TREATING EGFR POSITIVE CANCERS

(71) Applicant: A2 Biotherapeutics, Inc., Agoura Hills, CA (US)

(72) Inventors: Julyun Oh, Agoura Hills, CA (US); Han Xu, Agoura Hills, CA (US); Carl Alexander Kamb, Agoura Hills, CA (US)

(73) Assignee: A2 Biotherapeutics, Inc., Agoura Hills, CA (US)

( * ) Notice: Subject to any disclaimer, the term of this patent is extended or adjusted under 35 U.S.C. 154(b) by 0 days.

(21) Appl. No.: 17/663,758

(22) Filed: May 17, 2022

(65) Prior Publication Data
US 2022/0273721 A1 Sep. 1, 2022

Related U.S. Application Data

(63) Continuation of application No. PCT/US2021/046733, filed on Aug. 19, 2021.

(60) Provisional application No. 63/230,632, filed on Aug. 6, 2021, provisional application No. 63/105,639, filed on Oct. 26, 2020, provisional application No. 63/068,249, filed on Aug. 20, 2020.

(51) Int. Cl.
| A61K 35/17 | (2015.01) |
| A61P 35/00 | (2006.01) |
| A61K 35/15 | (2015.01) |
| C07K 14/705 | (2006.01) |
| C07K 16/28 | (2006.01) |
| C12N 5/09 | (2010.01) |

(52) U.S. Cl.
CPC .............. *A61K 35/17* (2013.01); *A61K 35/15* (2013.01); *A61P 35/00* (2018.01); *C07K 14/705* (2013.01); *C07K 16/2833* (2013.01); *C07K 16/2863* (2013.01); *C12N 5/0693* (2013.01)

(58) Field of Classification Search
CPC ......................... C07K 16/2863; C07K 16/2833; A61K 35/15; A61K 35/17
See application file for complete search history.

(56) References Cited

U.S. PATENT DOCUMENTS

| 4,690,915 | A | 9/1987 | Gross et al. |
| 5,350,674 | A | 9/1994 | Boenisch et al. |
| 5,585,362 | A | 12/1996 | Wilson et al. |
| 5,858,358 | A | 1/1999 | June et al. |
| 5,883,223 | A | 3/1999 | Gray |
| 6,326,193 | B1 | 12/2001 | Liu et al. |
| 6,352,694 | B1 | 3/2002 | June et al. |
| 6,534,055 | B1 | 3/2003 | June et al. |
| 6,692,964 | B1 | 2/2004 | June et al. |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |
| 7,067,318 | B2 | 6/2006 | June et al. |
| 7,144,575 | B2 | 12/2006 | June et al. |
| 7,172,869 | B2 | 2/2007 | June et al. |
| 7,175,843 | B2 | 2/2007 | June et al. |
| 7,232,566 | B2 | 6/2007 | June et al. |
| 8,697,359 | B1 | 4/2014 | Zhang |
| 8,771,945 | B1 | 7/2014 | Zhang |
| 8,795,965 | B2 | 8/2014 | Zhang |
| 8,865,406 | B2 | 10/2014 | Zhang et al. |
| 8,871,445 | B2 | 10/2014 | Cong et al. |
| 9,745,368 | B2 | 8/2017 | Milone et al. |
| 10,040,846 | B2 | 8/2018 | Frigault et al. |
| 10,172,885 | B2 | 1/2019 | Pulé et al. |
| 10,172,886 | B2 | 1/2019 | Pulé et al. |
| 11,254,726 | B2 | 2/2022 | Kamb et al. |
| 2003/0170238 | A1 | 9/2003 | Gruenberg et al. |
| 2004/0101519 | A1 | 5/2004 | June et al. |
| 2005/0244858 | A1 | 11/2005 | Rossi et al. |
| 2006/0034810 | A1 | 2/2006 | Riley et al. |
| 2006/0121005 | A1 | 6/2006 | Berenson et al. |
| 2014/0068797 | A1 | 3/2014 | Doudna et al. |
| 2015/0376296 | A1 | 12/2015 | Fedorov et al. |
| 2016/0289293 | A1 | 10/2016 | Pulé et al. |
| 2017/0296623 | A1 | 10/2017 | Juillerat et al. |
| 2018/0044399 | A1 | 2/2018 | Rajpal et al. |
| 2018/0346541 | A1 | 12/2018 | Wong et al. |
| 2019/0023761 | A1 | 1/2019 | Pulé et al. |
| 2019/0185849 | A1 | 6/2019 | Lundberg et al. |
| 2019/0248869 | A1 | 8/2019 | Gross et al. |
| 2019/0290691 | A1 | 9/2019 | Jäckel et al. |

(Continued)

FOREIGN PATENT DOCUMENTS

| EP | 3632461 A1 | 4/2020 |
| EP | 3634990 A1 | 4/2020 |

(Continued)

OTHER PUBLICATIONS

Brea et al, Cancer Immunol Res, 2016, vol. 4, pp. 936-947 (Year: 2016).*
Fedorov et al (Science Translational Medicine, 2013, vol. 5, No. 215, 215ra172) (Year: 2013).*
Daher and Rezvani, Cancer Discovery, 2021, vol. 11, pp. 45-58 (Year: 2021).*
Morgan et al (Frontiers in Immunology, 2020, vol. 11, Article 1965) (Year: 2020).*
Guo et al (Clinical Cancer Research, 2017, vol. 24, pp. 1277-1286) (Year: 2017).*
McCreedy et al (Best Practice & Research Clinical Haematology, 2018, vol. 31, pp. 166-175) (Year: 2018).*

(Continued)

*Primary Examiner* — Karen A. Canella
(74) *Attorney, Agent, or Firm* — Mintz Levin Cohn Ferris Glovsky and Popeo, P.C.; James Whittle; Anna Mirón

(57) ABSTRACT

The disclosure provides immune cells comprising a first activator receptor and a second inhibitory receptor, and methods of making and using same for the treatment of cancer.

27 Claims, 33 Drawing Sheets

Specification includes a Sequence Listing.

(56) References Cited

U.S. PATENT DOCUMENTS

| | | |
|---|---|---|
| 2019/0359678 A1 | 11/2019 | O'Donoghue et al. |
| 2020/0016203 A1 | 1/2020 | Pul et al. |
| 2020/0016204 A1 | 1/2020 | Pul et al. |
| 2020/0188434 A1 | 6/2020 | Cordoba et al. |
| 2020/0199550 A1 | 6/2020 | Cordoba et al. |
| 2020/0261499 A1 | 8/2020 | Gross et al. |
| 2020/0316120 A1 | 10/2020 | Gross et al. |
| 2021/0206826 A1 | 7/2021 | Lim et al. |
| 2021/0230247 A1 | 7/2021 | Kamb et al. |
| 2021/0230251 A1 | 7/2021 | Gross et al. |

FOREIGN PATENT DOCUMENTS

| | | | |
|---|---|---|---|
| EP | 3688155 A1 | 8/2020 | |
| WO | 0129058 A1 | 4/2001 | |
| WO | 0196584 A2 | 12/2001 | |
| WO | 2014145252 A2 | 9/2014 | |
| WO | 2015017214 A1 | 2/2015 | |
| WO | 2015075468 A1 | 5/2015 | |
| WO | 2015120096 A2 | 8/2015 | |
| WO | 2015136001 A1 | 9/2015 | |
| WO | 2015142314 A1 | 9/2015 | |
| WO | 2016075612 A1 | 5/2016 | |
| WO | 2016097231 A2 | 6/2016 | |
| WO | 2016126608 A1 | 8/2016 | |
| WO | 2016138034 A1 | 9/2016 | |
| WO | 2016142532 A1 | 9/2016 | |
| WO | 2016160622 A2 | 10/2016 | |
| WO | 2017011804 A1 | 1/2017 | |
| WO | 2017079705 A1 | 5/2017 | |
| WO | 2017087723 A1 | 5/2017 | |
| WO | 2017091905 A1 | 6/2017 | |
| WO | 2017156484 A1 | 9/2017 | |
| WO | 2018061012 A1 | 4/2018 | |
| WO | 2018144535 A1 | 8/2018 | |
| WO | 2018148454 A1 | 8/2018 | |
| WO | 2018211244 A1 | 11/2018 | |
| WO | 2018211245 A1 | 11/2018 | |
| WO | 2018211246 A1 | 11/2018 | |
| WO | 2019056099 A1 | 3/2019 | |
| WO | 2019068007 A1 | 4/2019 | |
| WO | 2019090215 A2 | 5/2019 | |
| WO | 2019241549 A1 | 12/2019 | |
| WO | 2020065406 A2 | 4/2020 | |
| WO | 2020070290 A1 | 4/2020 | |
| WO | 2021030153 A2 | 2/2021 | |
| WO | 2021030182 A1 | 2/2021 | |
| WO | 2021035093 A1 | 2/2021 | |
| WO | WO-2021030149 A1 * | 2/2021 | ............. A61K 35/17 |
| WO | 2021096868 A1 | 5/2021 | |
| WO | 2021119489 A1 | 6/2021 | |
| WO | 2021222576 A1 | 11/2021 | |
| WO | 2022040444 A1 | 2/2022 | |

OTHER PUBLICATIONS

European Search Report corresponding to European Patent Application No. 17855171.9, dated Mar. 26, 2020, 8 pages.
International Search Report and Written Opinion issued in International Application No. PCT/US2020/064607, dated Mar. 12, 2021, 11 pages.
International Search Report with Written Opinion corresponding to International Patent Application No. PCT/IL17/51102, dated Jan. 14, 2018, 8 pages.
Non-Final Office Action issued by The United States Patent and Trademark Office for U.S. Appl. No. 17/230,637, dated Aug. 31, 2021, 11 pages.
Notice of Allowance Office Action issued by The United States Patent and Trademark Office for U.S. Appl. No. 17/230,637, dated Dec. 13, 2021, 9 pages.
Notice of Allowance Office Action issued by The United States Patent and Trademark Office for U.S. Appl. No. 17/230,637, dated Dec. 24, 2021, 5 pages.

Abecasis et al., 2010, "A map of human genome variation from population-scale sequencing", Nature—1000 Genomes Project Consortium, 467*(7319):1061-1073.
Abeyweera et al., 2011, "Inhibitory signaling blocks activating receptor clustering and induces cytoskeletal retraction in natural killer cells", Journal of Cell Biology, 192(4):675-690.
Altschul et al. (Oct. 5, 1990) "Basic Local Alignment Search Tool", Journal of Molecular Biology, 215(3):403-410.
Altschul et al. (Sep. 1, 1997) "Gapped BLAST and PSI-BLAST: A New Generation of Protein Database Search Programs", Nucleic Acids Research, 25(17):3389-3402.
Auton (2015) "A global reference for human genetic variation", Nature, 526(7571):68-74.
Badran et al. (Dec. 6, 2002) "Identification of Three NFAT Binding Motifs in the 5'-Upstream Region of the Human CD3γ Gene That Differentially Bind NFATc1, NFATc2, and NF-κB p50", The Journal of Biological Chemistry, 277(49):47136-47148.
Barrett et al. (May 1999) "Evolution of Neoplastic Cell Lineages in Barrett Oesophagus", Nature Genetics, 22(1):106-109.
Basilion et al. (Aug. 1999) "Selective Killing of Cancer Cells Based on Loss of Heterozygosity and Normal Variation in the Human Genome: A New Paradigm for Anticancer Drug Therapy", Molecular Pharmacology, 56(2):359-369.
Bausch-Fluck et al. (Apr. 20, 2015) "A Mass Spectrometric-Derived Cell Surface Protein Atlas", PloS one, 10(4): e0121314. 22 pages.
Bayle et al. (Jan. 2006) "Rapamycin analogs with differential binding specificity permit orthogonal control of protein activity", Chemistry & Biology, 13(1):99-107.
Bellon et al. (2002) "Mutational Analysis of Immunoreceptor Tyrosine-Based Inhibition Motifs of the Ig-Like Transcript 2 (CD85j) Leukocyte Receptor", Journal of Immunology, 168(7):3351-3359.
Bergbold et al. (Dec. 2013) "Emerging Role of Rhomboid Family Proteins in Mammalian Biology and Disease", Biochimica et Biophysica Acta (BBA)—Biomembranes, 1828(12):2840-2848.
Berge et al. (Dec. 1998) "Selective Expansion of a Peripheral Blood Cd8+ Memory T Cell Subset Expressing Both Granzyme B and L-selectin During Primary Viral Infection in Renal Allograft Recipients", Transplantation Proceedings, 30(8):3975-3977.
Beroukhim et al. (Feb. 18, 2010) "The Landscape of Somatic Copy-number Alteration Across Human Cancers", Nature, 463(7283):899-905 (17 pages).
Binstadt et al. (Dec. 1996) "Sequential Involvement of Lck And SHP-1 With MHC-Recognizing Receptors on NK ells Inhibits FcR-initiated Tyrosine Kinase Activation", Immunity, 5(6):629-638.
Blankenstein et al. (Apr. 2015) "Targeting Cancer-specific Mutations by T cell Receptor Gene Therapy", Current opinion in immunology, 33:112-119.
Boczkowski et al. (2000) "Induction of Tumor Immunity and Cytotoxic T Lymphocyte Responses using Dendritic Cells Transfected with Messenger RNA Amplified from Tumor Cells", Cancer Research, 60(4):1028-1034.
Burrell et al. (2013) "The Causes and Consequences of Genetic Heterogeneity in Cancer Evolution", Nature, 501(7467):338-345.
Caescu et al. (Oct. 2009) "Active site determinants of substrate recognition by the metalloproteinases TACE and ADAM10", Biochemical Journal, 424(1):79-88.
Campoli et al. (Oct. 6, 2008) "HLA Antigen Changes in Malignant Cells: Epigenetic Mechanisms and Biologic Significance", Oncogene, 27(45):5869-5885.
Carney et al. (Oct. 1986) "Monoclonal Antibody Specific for an Activated RAS Protein", Proceedings of the National Academy of Sciences of the United States of America, 83(19):7485-7489.
Cerami et al. (May 2012) The eBio Cancer Genomics Portal: An Open Platform for Exploring Multidimensional Cancer Genomics Data, Cancer Discovery, 2(5):401-404.
Chao et al. (2006) "Isolating and Engineering Human Antibodies using Yeast Surface Display", Nature Protocols, 1(2):755-768.
Chen et al. (Mar. 21, 2012) "Structural and Functional Distinctiveness of HLA-A2 Allelic Variants", Immunologic Research, 53:182-190.

(56) References Cited

OTHER PUBLICATIONS

Chess Andrew (2012) "Mechanisms and Consequences of Widespread Random Monoallelic Expression", Nature Reviews Genetics, 13(6):421-428.
Chicaybam et al. (2014) "Construction and validation of an activating and inhibitory chimeric antigen receptor (CAR) system", Cancer Research, Abstract 2797, 74(15):2 pages.
Chicaybam et al. (2015) "Construction and validation of an activating and inhibitory chimeric antigen receptor (CAR) system", Cancer Research, Abstract 3156, 75(15):2 pages.
Cordoba et al. (May 23, 2013) "The large ectodomains of CD45 and CD148 regulate their segregation from and inhibition of ligated T-cell receptor", Blood, 121(21):4295-4302.
Da Cunha et al. (2009) "Bioinformatics construction of the human cell surfaceome", Proc Natl Acad Sci U S A., 106(39):16752-16757.
Devilee et al. (2001) "Eversince Knudson", Trends in genetics, 17(10):569-573.
Dotti et al. (Jan. 2014) "Design and Development of Therapies using Chimeric Antigen Receptor-Expressing T cells", Immunological Reviews, 257(1):107-126.
Ebsen et al. (Oct. 9, 2013) "Differential Surface Expression of ADAM10 and ADAM17 on Human T Lymphocytes and Tumor Cells", PloS one, e76853, 8(10):16 pages.
Ellis et al. (Mar. 2000) "Frequencies of HLA-A2 Alleles in Five U.S. Population Groups: Predominance of A*02011 and Identification of HLA-A*0231", Human Immunology, 61(3):334-340.
Eriksson et al. (Oct. 4, 1999) "Inhibitory Receptors Alter Natural Killer Cell Interactions with Target Cells Yet Allow Simultaneous Killing of Susceptible Targets", The Journal of Experimental Medicine, 190(7):1005-1012.
Feenstra et al. (1999) "HLA Class I Expression and Chromosomal Deletions at 6p and 15q in Head and Neck Squamous Cell Carcinomas", Tissue antigens, 54(3):235-245.
Gao et al. (2013) "Integrative Analysis of Complex Cancer Genomics and Clinical Profiles Using the cBioPortal", Sci Signal., 6(269):1-34.
Garland et al. (Jul. 30, 1999) "The Use of Teflon Cell Culture Bags to Expand Functionally Active CD8+ Cytotoxic T Lymphocytes", Journal of Immunological Methods, 227(1-2):53-63.
Gill et al. (Jan. 2015) "Going Viral: Chimeric Antigen Receptor T-Cell Therapy for Hematological Malignancies", Immunological Reviews, 263(1):68-89.
Gordon et al. (Jun. 22, 2015) "Mechanical Allostery: Evidence for a Force Requirement in the Proteolytic Activation of Notch", Developmental Cell, 33(6):729-736 (20 pages).
Graef et al. (1997) "Proximity and Orientation Underlie Signaling by the Non-Receptor Tyrosine Kinase ZAP70", The EMBO, 16(18):5618-5628.
Gross et al. (Dec. 1989) "Expression of Immunoglobulin-T-Cell Receptor Chimeric Molecules as Functional Receptors with Antibody-Type Specificity", Proc. Natl. Acad. Sci. USA, 86(24):10024-10028.
Gross et al. (2016) "Therapeutic Potential of T Cell Chimeric Antigen Receptors (CARs) in Cancer Treatment: Counteracting Off-Tumor Toxicities for Safe CAR T Cell Therapy", Annual Review of Pharmacology and Toxicology, 56:59-83.
GTEX Consortium (2015) "The Genotype-Tissue Expression (GTEx) Pilot Analysis: Multitissue Gene Regulation in Humans", Science, 348(6235):648-660. 33 pages.
Gustafson et al. (2017) "Immune Checkpoint Function of CD85j in CD8 T Cell Differentiation and Aging", Frontiers in Immunology, 8(692)1-12.
Haanen et al. (Nov. 1, 1999) "Selective Expansion of Cross-Reactive Cd8+ Memory T Cells by Viral Variants", Journal of Experimental Medicine, 190(9): 1319-1328.
Haapasalo et al. (2011) "The Many Substrates of Presenilin/γ-Secretase", Journal of Alzheimer's disease, 25(1):3-28.
Hamburger et al. (Dec. 2020) "Engineered T cells directed at tumors with defined allelic loss", Molecular Immunology, 128:298-310.

Hanes et al. (May 1997) "In Vitro Selection and Evolution of Functional Proteins by Using Ribosome Display", Proceedings of the National Academy of Sciences, 94(10):4937-4942.
Harrer et al. (May 2018) "Chimeric Antigen Receptors in Different Cell Types: New Vehicles Join the Race", Human Gene Therapy, 29(5):547-558.
Heemskerk et al. (2013) "The Cancer Antigenome", The EMBO journal, 32(2):194-203.
Hemming et al. (Dec. 29, 2009) "Identification of β-Secretase (BACE1) Substrates Using Quantitative Proteomics", PLoS ONE, e8477, 4(12):1-14.
Hilton et al. (Apr. 2013) "Direct binding to antigen-coated beads refines the specificity and cross-reactivity of four monoclonal antibodies that recognize polymorphic epitopes of HLA class I molecules", Tissue Antigens, 81(4):212-220.
Huse et al. (2013) "Building Tolerance by Dismantling Synapses: Inhibitory Receptor Signaling in Natural Killer Cells", Immunological reviews, 251(1):143-153.
Huston et al. (Aug. 1, 1988) "Protein Engineering of Antibody Binding Sites: Recovery of Specific Activity in an Anti-Digoxin Single-Chain Fv Analogue Produced in *Escherichia Coli*.", Proceedings of the National Academy of Sciences of the United States of America, 85(16):5879-5883.
Hwang et al. (Mar. 17, 2021) "Targeting Loss of Heterozygosity for Cancer-specific Immunotherapy", Proceedings of the National Academy of Sciences of the United States of America, e2022410118, 118(12):1-10 pages.
Irles et al. (2003) "CD45 ectodomain Controls Interaction with GEMs and Lck Activity for Optimal TCR Signaling", Nature Immunology, 4:189-197.
Jimenez et al. (1999) "Chromosome Loss is the Most Frequent Mechanism Contributing to HLA Haplotype Loss in Human Tumors", International Journal of Cancer, 83(1):91-97.
Kang et al. (Dec. 4, 2015) "Inhibitory leukocyte Immunoglobulin-like Receptors: Immune Checkpoint Proteins and Tumor Sustaining Factors", Cell Cycle, 15(1):25-40.
Karlin et al. (Jun. 1993) "Applications and Statistics for Multiple High-Scoring Segments in Molecular Sequences", Proceedings of the National Academy of Sciences, 90(12):5873-5877.
Karlin et al. (Mar. 1990) "Methods for Assessing the Statistical Significance of Molecular Sequence Features by Using General Scoring Schemes", Proceedings of the National Academy of Sciences of the United States of America, 87(6):2264-2268.
Klebanoff et al. (2016) "Prospects for Gene-engineered T Cell Immunotherapy for Solid Cancers", Nature medicine, 22(1):26-36 (25 pages).
Kloss et al. (2013) "Combinatorial Antigen Recognition with Balanced Signaling Promotes Selective Tumor Eradication by Engineered T Cells", Nature biotechnology, 31(1):71-75 (15 pages).
Knudson et al. (1971) "Mutation and Cancer: Statistical Study of Retinoblastoma", Proceedings of the National Academy of Sciences, 68(4):820-823.
Lanitis et al. (2013) "Chimeric Antigen Receptor T Cells with Dissociated Signaling Domains Exhibit Focused Anti-Tumor Activity with Reduced Potential for Toxicity In Vivo", Cancer immunology research, 1(1):43-53. 20 pages.
Lawrence et al. (2014) "Discovery and Saturation Analysis of Cancer Genes Across 21 Tumor Types", Nature, 505(7484): 495-501. 22 pages.
Lawrence et al. (2013) "Mutational heterogeneity in cancer and the search for new cancer-associated genes", Nature, 499(7457):214-218. 12 pages.
Lee et al. (Mar. 2003) "Distribution Analysis of Nonsynonymous Polymorphisms within the G-Protein-Coupled Receptor Gene Family", Genomics, 81(3):245-248.
Lek et al. (2016) "Analysis of Protein-Coding Genetic Variation in 60,706 Humans", Nature, 536(7616):285-291 (33 pages).
Lengauer et al. (1998) "Genetic Instabilities in Human Cancers", Nature, 396(6712):643-649.
Leung et al. (2019) "Sensitive and adaptable pharmacological control of CAR T cells through extracellular receptor dimerization", JCI Insight, e124430, 4(11):19 pages.

(56) References Cited

OTHER PUBLICATIONS

Li et al. (2014) "A Preliminary Study of the Relationship Between Breast Cancer Metastasis and Loss of Heterozygosity by Using Exome Sequencing", Scientific Reports, 4:5460(1-6).
Li et al. (Mar. 2020) "LILRB4 ITIMs mediate the T cell suppression and infiltration of acute myeloid leukemia cells", Cellular & Molecular Immunology, 17(3):272-282.
Liberles et al. (Jul. 1997) "Inducible Gene Expression and Protein Translocation Using Nontoxic Ligands Identified by a Mammalian Three-hybrid Screen", Proceedings of the National Academy of Sciences, 94(15):7825-7830.
Lindblad-Toh et al. (2000) "Loss-of-heterozygosity Analysis of Small-cell Lung Carcinomas Using Single-nucleotide Polymorphism Arrays", Nature Biotechnology, 18(9):1001-1005.
Lo et al. (2008) "Comprehensive Analysis of Loss of Heterozygosity Events in Glioblastoma using the 100K SNP Mapping Arrays and Comparison with Copy Number Abnormalities Defined by BAC Array Comparative Genomic Hybridization", Genes Chromosomes Cancer, 47(3):221-237.
Long et al. (2013) "Controlling NK Cell Responses: Integration of Signals for Activation and Inhibition", Annual Review of Immunology, 31:227-258 (36 pages).
MacDonald et al. (2016) "Alloantigen-specific Regulatory T Cells Generated with a Chimeric Antigen Receptor", Journal of Clinical Investigation, 126(4):1413-1424.
Maleno et al. (2004) "Distribution of HLA Class I Altered Phenotypes in Colorectal Carcinomas: High Frequency of HLA Haplotype Loss Associated with Loss of Heterozygosity in Chromosome Region 6p21", Immunogenetics, 56(4):244-253.
Maleno et al. (2010) "Frequent Loss of Heterozygosity in the B2-Microglobulin Region of Chromosome 15 in Primary Human Tumors", Immunogenetics, 63(2):65-71.
Maleno et al. (2006) "LOH at 6p21.3 Region and HLA Class Altered Phenotypes in Bladder Carcinomas", Immunogenetics, 58(7):503-510.
Maleno et al. (2002) "Multiple Mechanisms Generate HLA Class I Altered Phenotypes in Laryngeal Carcinomas: High Frequency of HLA Haplotype Loss Associated with Loss of Heterozygosity in Chromosome Region 6p21", Cancer Immunology, Immunotherapy, 51(7):389-396.
Maus et al. (2016) "An MHC-Restricted Antibody-Based Chimeric Antigen Receptor Requires TCR-Like Affinity to Maintain Antigen Specificity", Molecular Therapy—Oncolytics, 3(16023):1-9.
McEvoy et al. (2002) "Frequency and Genetic Basis of MHC, beta-2-microglobulin and MEMO-1 Loss of Heterozygosity in Sporadic Breast Cancer", Tissue Antigens, 60(3):235-243.
McGranahan et al. (2012) "Cancer Chromosomal Instability: Therapeutic and Diagnostic Challenges", EMBO reports, 13(6):528-538.
Medintz et al. (2000) "Loss of Heterozygosity Assay for Molecular Detection of Cancer Using Energy-transfer Primers and Capillary Array Electrophoresis", Genome Research, 10(8):1211-1218.
Morgan et al. (Apr. 2010) "Case Report of a Serious Adverse Event Following the Administration of T Cells Transduced with a Chimeric Antigen Receptor Recognizing ERBB2", Molecular Therapy, 18(4):843-851.
Morsut et al. (Feb. 11, 2016) "Engineering Customized Cell Sensing and Response Behaviors using Synthetic Notch Receptors", Cell, 164(4):780-791.
Natali et al. (Sep. 1, 1989) Selective Changes in Expression of HLA Class I Polymorphic Determinants in Human Solid Tumors, Proceedings of the National Academy of Sciences of the United States of America, 86(17):6719-6723.
Ng et al. (2003) "SIFT: Predicting Amino Acid Changes that Affect Protein Function", Nucleic Acids Research, 31(13):3812-3814.
Nirschl et al. (Sep. 15, 2013) "Molecular Pathways: Coexpression of Immune Checkpoint Molecules: Signaling Pathways and Implications for Cancer Immunotherapy", Clinical Cancer Research, 19(18):4917-4924.
Norell et al. (Jun. 15, 2006) "Frequent Loss of HLA-A2 Expression in Metastasizing Ovarian Carcinomas Associated with Genomic Haplotype Loss and HLA-A2-Restricted HER-2/neu-Specific Immunity", Cancer Research, 66(12):6387-6394.
Ohgaki et al. (Oct. 1, 2004) "Genetic Pathways to Glioblastoma A Population-Based Study", Cancer Research, 64(19):6892-6899.
O'Keefe et al. (2010) "Copy Neutral Loss of Heterozygosity: A Novel Chromosomal Lesion in Myeloid Malignancies", Blood, 115(14):2731-2739.
Overwijk et al. (2013) "Mining the Mutanome: Developing Highly Personalized Immunotherapies Based on Mutational Analysis of Tumors", Journal for ImmunoTherapy of Cancer, 1:11 (1-4).
Patel et al. (2014) "Cancer CARtography: Charting Out a New Approach to Cancer Immunotherapy", Immunotherapy, 6(6):675-678 (6 pages).
Paucek et al. (Apr. 2019) "The Cellular Immunotherapy Revolution: Arming the Immune System for Precision Therapy", Trends in Immunology, 40(4):292-309.
Rana et al. (2001) "Genetic Variations and Polymorphisms of G Protein-coupled Receptors: Functional and Therapeutic Implications", Annual Review of Pharmacology and Toxicology, 41(1):593-624.
Rawson Robert B. (2013) "The Site-2 Protease", Biochimica et Biophysica Acta (BBA)—Biomembranes, 1828(12):2801-2807.
Rosenberg et al. (2015) "Adoptive Cell Transfer as Personalized Immunotherapy for Human Cancer", Science, 348(6230):62-68.
Rosenberg Steven A. (2014) "Finding Suitable Targets is the Major Obstacle to Cancer Gene Therapy", Cancer Gene Therapy, 21:45-47.
Roybal et al. (Feb. 11, 2016) "Precision Tumor Recognition by T Cells with Combinatorial Antigen-Sensing Circuits", Cell, 164:770-779.
Sathirapongsasuti et al. (2011) "Exome Sequencing-based Copy-number Variation and Loss of Heterozygosity Detection: Exomecnv", Bioinformatics, 27(19):2648-2654.
Savage Peter A. (2014) "Tumor Antienicity Revealed", Trends in immunology, 35(2):47-48(3 pages).
Savova et al. (2016) "Genes with Monoallelic Expression Contribute Disproportionately to Genetic Diversity in Humans", Nature Genetics, 48(3):231-237(25 pages).
Sayós et al. (2004) "Recruitment of C-Terminal SRC Kinase by the Leukocyte Inhibitory Receptor CD85j", Biochemical and Biophysical Research Communications, 324(2):640-647.
Schumacher et al. (Apr. 3, 2015) "Neoantigens in Cancer Immunotherapy", Science, 348(6230):69-74.
Sela-Culang (Apr. 2015) "Antibody Specific Epitope Predictionemergence of a New Paradigm", Current opinion in virology, 11:98-102.
Sela-Culang et al. (Apr. 15, 2015) "PEASE: predicting B-cell epitopes utilizing antibody sequence", Bioinformatics, 31(8):1313-1315.
Skora et al. (Aug. 11, 2015) "Generation of MANAbodies Specific to HLA-Restricted Epitopes Encoded by Somatically Mutated Genes", Proceedings of the National Academy of Sciences, 112(32):9967-9972.
Skuljec et al. (Sep. 12, 2017) "Chimeric Antigen Receptor-Redirected Regulatory T Cells Suppress Experimental Allergic Airway Inflammation, a Model of Asthma", Frontiers in Immunology, Article 1125, 8:12 pages.
Stark et al. (Sep. 1, 1991) "Antibodies that are Specific for a Single Amino Acid Interchange in a Protein Epitope Use Structurally Distinct Variable Regions", The Journal of Experimental Medicine, 174(3):613-624.
Stark, et al. (Mar. 15, 2007) "Genome-Wide Loss of Heterozygosity and Copy Number Analysis in Melanoma using High-Density Single-Nucleotide Polymorphism Arrays", Cancer Research, 67(6):2632-2642.
Sun et al. (Jun. 11, 2014) "Construction and Evaluation of a Novel Humanized HER2-Specific Chimeric Receptor", Breast Cancer Research, R61, 16(3):10 pages.
Teo et al. (Nov. 1, 2012) "Statistical Challenges Associated with Detecting Copy Number Variations with Next-Generation Sequencing", Bioinformatics, 28(21):2711-2718.
Thul et al. (May 26, 2017) "A Subcellular Map of the Human Proteome", Science, eaal3321, 356(6340):14 pages.

(56) References Cited

OTHER PUBLICATIONS

Treanor et al. (Jul. 3, 2006) "Microclusters of Inhibitory Killer Immunoglobulin-like Receptor Signaling at Natural Killer Cell Immunological Synapses", The Journal of cell biology, 174(1):153-161.
Uhlen et al. (Jan. 23, 2015) "Tissue-based Map of the Human Proteome", Science, 347(6220):1260419(11 pages).
Ui-Tei et al. (2000) "Sensitive Assay of RNA Interference in Drosophila and Chinese Hamster Cultured Cells Using Firefly Luciferase Gene as Target", FEBS Letters, 479:79-82.
Van Buuren et al. (May 14, 2014) "High Sensitivity of Cancer Exome-Based CD8 T Cell Neo-Antigen Identification", Oncoimmunology, e28836, 3:6 pages.
Vogelstein et al. (Apr. 14, 1989) "Allelotype of Colorectal Carcinomas", Science, 244(4901):207-211.
Vogelstein et al. (Mar. 29, 2013) "Cancer Genome Landscapes", Science, 339(6127):1546-1558.
Voss et al. (Dec. 2013) "Mechanism, Specificity, and Physiology of Signal Peptide Peptidase (SPP) and SPP-like Proteases", Biochimica Et Biophysica Acta (BBA)—Biomembranes, 1828(12):2828-2839.
Vyas et al. (Oct. 15, 2001) "Spatial organization of signal transduction molecules in the NK cell immune synapses during MHC class I-regulated noncytolytic and cytolytic interactions", The Journal of immunology, 167(8):4358-4367.
Walseng et al. (Sep. 6, 2017) "A TCR-based Chimeric Antigen Receptor", Scientific Reports, 7(1):10 pages.
Wang et al. (Jan. 1, 2004) "Loss of heterozygosity and its Correlation with Expression Profiles in Subclasses of Invasive Breast Cancers", Cancer research, 64(1):64-71.
Wilkie et al. (Oct. 2012) "Dual targeting of ErbB2 and MUC1 in breast cancer using chimeric antigen receptors engineered to provide complementary signaling", Journal of Clinical Immunology, 32(5):1059-1070.
Wu et al. (Oct. 16, 2015) "Remote Control of Therapeutic T Cells Through a Small Molecule-Gated Chimeric Receptor", Science, aab4077, 350(6258):21 pages.
Yeung et al., Apr. 1, 2013, "LOH in the HLA class I region at 6p21 is Associated with Shorter Survival in Newly Diagnosed Adult Glioblastoma", Clinical Cancer Research, 19(7):1816-1826.
Yu et al. (Mar. 29, 2017) "Chimeric Antigen Receptor T cells: A Novel therapy for Solid Tumors", Journal of Hematology & Oncology, 10(1):78 (13 pages).
Alcover et al. (Apr. 26, 2018) "Cell Biology of T Cell Receptor Expression and Regulation", Annual Review of Immunology, 36:103-125.
Bird et al. (1988) "Single-Chain Antigen-Binding Proteins", Science, 242(4877):423-426.
Cong et al. (Feb. 15, 2013) "Multiplex Genome Engineering Using CRISPR/Cas Systems", Science, 339(6121):819-823 (9 pages).
Database Genbank (May 22, 2022) "Collectin-12 [*Homo Sapiens*]", NCBI Reference Sequence: NP_569057.2, 3 pages.
Database Genbank (May 15, 2022) "Epidermal Growth Factor Receptor Isoform A Precursor [*Homo Sapiens*]", NCBI Reference Sequence: NP_005219.2, 7 pages.
Database Genbank (May 15, 2022) "Epidermal Growth Factor Receptor Isoform B Precursor [*Homo Sapiens*]", NCBI Reference Sequence: NP_958439.1, 5 pages.
Database Genbank (May 15, 2022) "Epidermal Growth Factor Receptor Isoform C Precursor [*Homo Sapiens*]", NCBI Reference Sequence: NP_958440.1, 4 pages.
Database Genbank (May 15, 2022) "Epidermal Growth Factor Receptor Isoform D Precursor [*Homo Sapiens*]", NCBI Reference Sequence: NP_958441.1, 5 pages.
Database Genbank (May 15, 2022) "Epidermal Growth Factor Receptor Isoform E Precursor [*Homo Sapiens*]", NCBI Reference Sequence: NP_001333826.1, 3 pages.
Database Genbank (May 15, 2022) "Epidermal Growth Factor Receptor Isoform F Precursor [*Homo Sapiens*]", NCBI Reference Sequence: NP_001333827.1, 6 pages.
Database Genbank (May 15, 2022) "Epidermal Growth Factor Receptor Isoform H [*Homo Sapiens*]", NCBI Reference Sequence: NP_001333829.1, 3 pages.
Database Genbank (May 15, 2022) "Epidermal Growth Factor Receptor Isoform I Precursor [*Homo Sapiens*]", NCBI Reference Sequence: NP_001333870.1, 3 pages.
Database Genbank (Nov. 22, 2021) "*Homo Sapiens* Chromosome 15, GRCh38.p14 Primary Assembly", NCBI Reference Sequence: NC_000015.10, 3 pages.
Database Genbank (Sep. 1, 2020) "C-X-C Motif Chemokine 16 Precursor [*Homo Sapiens*]", NCBI Reference Sequence: NP_001094282.1, 3 pages.
Doench et al. (Jan. 18, 2016) "Optimized sgRNA Design to Maximize Activity and Minimize Off-target Effects of CRISPR-Cas9", Nature Biotechnology, 34:184-191.
GENBANK (Jul. 3, 2022) "HLA-A major histocompatibility complex, class I, A [*Homo sapiens* (human)]", Gene ID: 3105, 15 pages.
GENBANK (Jul. 3, 2022) "HLA-B major histocompatibility complex, class I, B [*Homo sapiens* (human)]", Gene ID: 3106, 14 pages.
GENBANK (Jul. 3, 2022) "HLA-C Major Histocompatibility Complex, Class I, C [*Homo sapiens* (human)]", Gene ID: 3107, 13 pages.
GENBANK (May 19, 2014) "*Homo sapiens* HLA-A gene for MHC class I antigen, isolate DKMS-LSL-A-160, allele HLA-A*02", Accession No. LK021978.1, 3 pages.
GENBANK (May 22, 2022) "B2M beta-2-microglobulin [*Homo sapiens* (human) ]", Gene ID: 567, 12 pages.
Hofmann et al. (1993) "TMbase—A database of membrane spanning proteins segments", Journal of Biological Chemistry, 347:166 (2 pages).
Houston et al. (Aug. 1988) "Protein Engineering of Antibody Binding Sites: Recovery of Specific Activity in an Anti-digoxin Single-chain Fv Analogue Produced in *Escherichia Coli*", Proceedings of the National Academy of Sciences of the United States of America, 85(16):5879-5883.
Krogh et al. (Jan. 19, 2001) "Predicting Transmembrane Protein Topology with a Hidden Markov Model: Application to Complete Genomes", Journal of Molecular Biology, 305(3):567-580.
Pennisi Elizabeth (Aug. 23, 2013) "The CRISPR Craze", Science, 341(6148):833-836.
Ren et al. (May 1, 2017) "Multiplex Genome Editing to Generate Universal CAR T Cells Resistant to PD1 Inhibition", Clinical Cancer Research, 23(9):2255-2266 (21 pages).
Tsai et al. (Jun. 2014) "Dimeric CRISPR RNA-Guided FokI Nucleases for Highly Specific Genome Editing", Nature Biotechnology, 32(6):569-576 (22 pages).
Wang et al. (Oct. 2015) "Targeted Disruption of the β2-Microglobulin Gene Minimizes the Immunogenicity of Human Embryonic Stem Cells", Stem Cells Translational Medicine, 4(10):1234-1245.
Wootton et al. (Jun. 1993) "Statistics of Local Complexity in Amino Acid Sequences and Sequence Databases", Computers & Chemistry, 17(2):149-163.

* cited by examiner

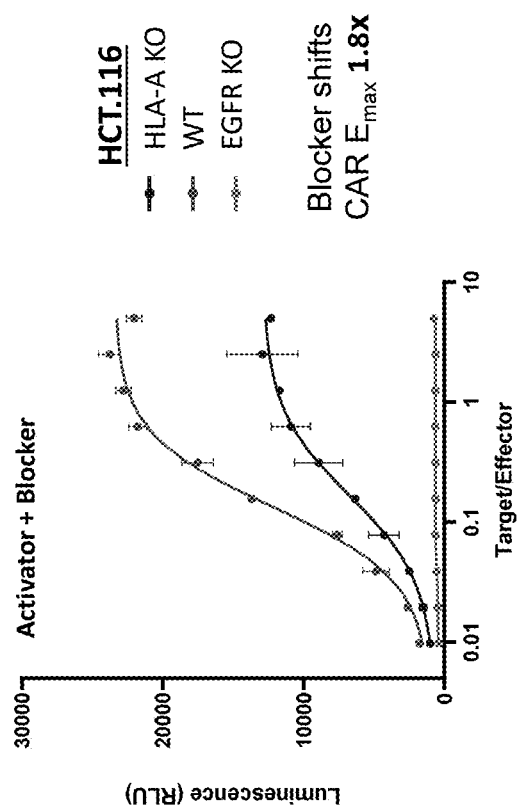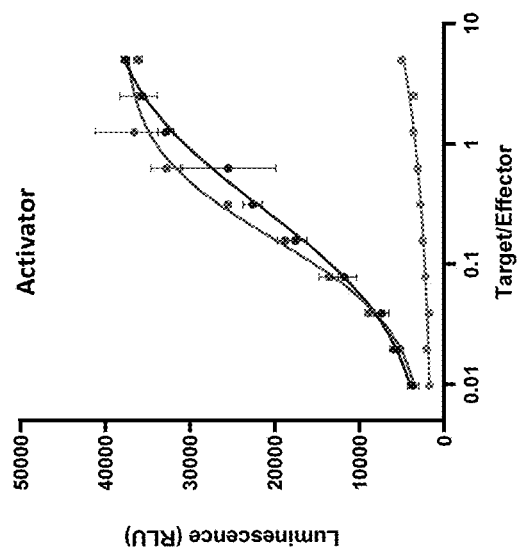

FIG. 20B

| Construct | On-target mRNA (ng) IC50 | On-target # of molecules IC50 |
|---|---|---|
| Empty vector | - | - |
| Activator CAR | - | - |
| Activator CAR + HLA-A*11 blocker-4 | 31.5 ng A*11 mRNA | ~23,000 (molecules per cell) |

COMPOSITIONS AND METHODS FOR TREATING EGFR POSITIVE CANCERS

CROSS REFERENCE TO RELATED APPLICATIONS

This application is a continuation of and claims priority to the International Patent Application No. PCT/US2021/046733, filed Aug. 19, 2021 and entitled "Compositions and Methods for Treating EGFR Positive Cancers," which claims priority to U.S. Provisional Application No. 63/068,249, filed on Aug. 20, 2020; U.S. Provisional Application No. 63/105,639, filed on Oct. 26, 2020; and U.S. Provisional Application No. 63/230,632, filed on Aug. 6, 2021, the contents of each of which are incorporated herein by reference in their entireties.

TECHNICAL FIELD

This application relates generally to engineered receptors and immune cell compositions comprising said receptors for use in cell therapy applications.

REFERENCE TO SEQUENCE LISTING

The sequence listing paragraph application contains a Sequence Listing which has been submitted in ASCII format via EFS-WEB and is hereby incorporated by reference in its entirety. Said ASCII copy, created on Aug. 17, 2021 is named A2BI_021_02WO_SeqList_ST25.txt and is 675 KB in size.

BACKGROUND

Cell therapy is a powerful tool for the treatment of various diseases, particularly cancers. In conventional adoptive cell therapies, immune cells are engineered to express specific receptors, for example chimeric antigen receptors (CARs) or T cell receptors (TCRs), which direct the activity of the immune cells to cellular targets via interaction of the receptor with a ligand expressed by the target cell. Identification of suitable target molecules remains challenging, as many targets are expressed in normal tissues. This expression can lead to toxicity when the transplanted cells target normal tissues expressing target molecules. There is thus a need in the art for compositions and methods useful in the treatment of disease, particularly cancers, by adoptive cell therapy.

SUMMARY

The disclosure provides compositions and methods for increasing the specificity of immune cells used in adoptive cell therapy. The disclosure provides immune cells comprising a two-receptor system that increases the specificity of the immune cells for target cells expressing a target antigen. The immune cells comprise a first, activator receptor that activates the immune cells in response to binding of the first receptor by the target antigen. The immune cells further comprise a second, inhibitory receptor specific to a non-target antigen. This second receptor inhibits activation of the immune cells when the second receptor is bound by the non-target antigen, even when the first receptor is bound by the target antigen.

In one aspect, the disclosure provides an immune cell, comprising: a.) a first receptor, comprising an extracellular ligand binding domain specific to Epidermal Growth Factor Receptor (EGFR); and b.) a second receptor, comprising an extracellular ligand binding domain specific to a non-target antigen lost in EGFR+ cancer due to loss of heterozygosity, wherein the first receptor is an activator receptor responsive to EGFR; and wherein the second receptor is an inhibitory receptor responsive to the non-target antigen.

In some embodiments, the extracellular ligand binding domain of the second receptor specifically binds an allelic variant of an MHC protein. In some embodiments, the extracellular ligand binding domain of the second receptor specifically binds an allelic variant of an HLA-A, HLA-B, or HLA-C protein. In some embodiments, the extracellular ligand binding domain of the second receptor specifically binds HLA-A*02. In some embodiments, the extracellular ligand binding domain of the second receptor specifically binds HLA-A*01, HLA-A*03, HLA-A*11, HLA-C*07, or HLA-B*07.

In some embodiments, the extracellular ligand binding domain of the second receptor comprises complementarity determining regions (CDRs) CDR-L1, CDR-L2, CDR-L3, CDR-H1, CDR-H2, CDR-H3 as disclosed Table 5; or CDR sequences having at most 1, 2, or 3 substitutions, deletions, or insertion relative to the CDRs of Table 5.

In some embodiments, the extracellular ligand binding domain of the second receptor comprises complementarity determining regions (CDRs) CDR-L1, CDR-L2, CDR-L3, CDR-H1, CDR-H2, CDR-H3 of SEQ ID NOs: 101-106 or of SEQ ID NOs: 106-112; or CDR sequences having at most 1, 2, or 3 substitutions, deletions, or insertion relative to the CDRs of Table 5.

In some embodiments, the extracellular ligand binding domain of the second receptor comprises a polypeptide sequence selected from the polypeptide sequence disclosed in Table 4; or a sequence having at least 85%, at least 90%, at least 95%, at least 97% or at least 99% identity thereto. In some embodiments, the extracellular ligand binding domain of the second receptor comprises any one of SEQ ID NOs: 89-100; or a sequence having at least 85%, at least 90%, at least 95%, at least 97% or at least 99% identity thereto.

In some embodiments, the first receptor is a chimeric antigen receptor (CAR).

In some embodiments, the extracellular ligand binding domain of the first receptor comprises a variable heavy (VH) portion comprising a set of heavy chain complementarity determining regions (HC-CDRs) selected from the group of sequences set forth Table 3; and/or a variable light (VL) portion comprising a set of light chain complementarity determining regions (LC-CDRs) from the group of sequences set forth in Table 3; or CDR sequences having at most 1, 2, 3, 4 substitutions, insertions, or deletions in each CDR.

In some embodiments, the extracellular ligand binding domain of the first receptor comprises a variable heavy (VH) portion having a sequence selected from the VH sequence set forth in Table 2; and/or a variable light (VL) portion comprising a sequence set forth in Table 2; or sequences having at least 70%, at least 85%, at least 90%, or at least 95% identity thereto.

In some embodiments, the extracellular ligand binding domain of the first receptor comprising a sequence selected from the group of sequences set forth in Table 1; or a sequence having at least 85%, at least 90%, at least 95%, at least 97%, or at least 99% identity thereto.

In some embodiments, the extracellular ligand binding domain of the first receptor comprises an scFv sequence selected from the group consisting of SEQ ID NO: 9-18; or a sequence having at least 85%, at least 90%, at least 95%, at least 97% or at least 99% identity thereto.

In some embodiments, the second receptor comprises a LILRB1 intracellular domain or a functional variant thereof. In some embodiments, the LILRB1 intracellular domain comprises a sequence at least 90%, at least 95%, at least 97%, at least 99%, or is identical to SEQ ID NO: 129.

In some embodiments, the second receptor comprises a LILRB1 transmembrane domain or a functional variant thereof. In some embodiments, the LILRB1 transmembrane domain or a functional variant thereof comprises a sequence at least 90%, at least 95%, at least 97%, at least 99% or is identical to SEQ ID NO: 133.

In some embodiments, the second receptor comprises a LILRB1 hinge domain or functional variant thereof. In some embodiments, the LILRB1 hinge domain comprises a sequence at least 90%, at least 95%, at least 97%, at least 99% or is identical to SEQ ID NO: 132, SEQ ID NO: 125, SEQ ID NO: 126.

In some embodiments, the second receptor comprises a LILRB1 intracellular domain, a LILRB1 transmembrane domain, a LILRB1 hinge domain, a functional variant of any of these, or combinations thereof. In some embodiments, the LILRB1 intracellular domain and LILRB1 transmembrane domain comprises SEQ ID NO: 128 or a sequence at least 95% identical to SEQ ID NO: 128.

In some embodiments, the EGFR+ cancer cell is a lung cancer cell, a small cell lung cancer cell, a non-small cell lung cancer cell, a pancreatic ductal carcinoma cell, a colorectal cancer cell, a head and neck cancer cell, a esophagus and gastric adenocarcinoma cell, an ovarian cancer cell, a glioblastoma multiforme cell, a cervical squamous cell carcinoma cell, a kidney cancer cell, a papillary kidney cancer cell, a kidney renal clear cell carcinoma cell, a bladder cancer cell, a breast cancer cell, a bile duct cancer cell, a liver cancer cell, a prostate cancer cell, a sarcoma cell, a thyroid cancer cell, a thymus cancer cell, a stomach cancer cell, or a uterine cancer cell.

In some embodiments, the EGFR+ cancer cell is an EGFR+/HLA-A*02− cancer cell that does not express HLA-A*02; or a cancer cell derived from an HLA-A*02+ individual which does not express HLA-A*02. In some embodiments, the EGFR+/HLA-A*02− cancer cell is derived from an EGFR+/HLA-A*02+ cell by loss of heterozygosity at HLA-A leading to loss of HLA-A*02.

In some embodiments, the first receptor and the second receptor together specifically activate the immune cell in the presence of the EGFR/HLA-A*02− cancer cell having loss of heterozygosity.

In some embodiments, the first receptor and the second receptor together do not specifically activate the immune cell in the presence of an EGFR+ cell that has not lost HLA-A*02 by loss of heterozygosity.

In some embodiments, the immune cell is a T cell, macrophage, NK cell, iNKT cell, or a gamma delta T cell. In some embodiments, the T cell is a CD8+CD4− T cell.

In some embodiments, the immune cell further comprises reduced or eliminated expression and/or function of an MHC Class I gene.

In some embodiments, the MHC Class I gene is beta-2-microglobulin (B2M).

In some embodiments, the immune cell further comprises a polynucleotide comprising an interfering RNA, the interfering RNA comprising a sequence complementary to a sequence of a B2M mRNA (SEQ ID NO: 172). In some embodiments, the interfering RNA is capable of inducing RNAi-mediated degradation of the B2M mRNA. In some embodiments, the interfering RNA is a short hairpin RNA (shRNA). In some embodiments, the shRNA comprises: a.) A first sequence, having from 5' end to 3' end a sequence complementary to a sequence of the B2M mRNA; and b.) A second sequence, having from 5' end to 3' end a sequence complementary to the first sequence, wherein the first sequence and the second sequence form the shRNA.

In some embodiments, the immune cell comprises one or more modifications to a sequence encoding B2M (SEQ ID NO: 170), wherein the one or more modifications reduce the expression and/or eliminate the function of B2M. In some embodiments, the one or more modifications comprise one or more inactivating mutations of the endogenous gene encoding B2M. In some embodiments, the one or more inactivating mutations comprise a deletion, an insertion, a substitution, or a frameshift mutation. In some embodiments, the one or more inactivating mutations are introduced with a nucleic acid guided endonuclease in a complex with at least one guide nucleic acid (gNA) that specifically targets a sequence of the endogenous gene encoding B2M (SEQ ID NO: 170).

In some embodiments, the MHC Class I gene is HLA-A*02.

In some embodiments, the immune cell further comprises a polynucleotide comprising an interfering RNA, comprising a sequence complementary to a sequence of an HLA-A*02 mRNA (SEQ ID NO: 171). In some embodiments, the interfering RNA is capable of inducing RNA interference (RNAi)-mediated degradation of the HLA-A*02 mRNA. In some embodiments, the interfering RNA is a short hairpin RNA (shRNA) comprising: a.) a first sequence, having from 5' end to 3' end a sequence complementary to a sequence of the HLA-A*02 mRNA; and b.) a second sequence, having from 5' end to 3' end a sequence complementary to the first sequence, wherein the first sequence and the second sequence form the shRNA.

In some embodiments, the immune cell comprises one or more modifications to a sequence of an endogenous gene encoding HLA-A*02 (SEQ ID NO: 169), wherein the one or modifications reduce the expression and/or eliminate the function of HLA-A*02. In some embodiments, the one or more modifications comprise one or more inactivating mutations of the endogenous gene encoding HLA-A*02. In some embodiments, the one or more inactivating mutations comprise a deletion, an insertion, a substitution, or a frameshift mutation. In some embodiments, the one or more inactivating mutations are introduced with a nucleic acid guided endonuclease in a complex with at least one guide nucleic acid (gNA) that specifically targets a sequence of the endogenous gene encoding HLA-A*02.

In some embodiments, the first receptor comprises SEQ ID NO: 177, or a sequence sharing at least 75%, at least 80%, at least 85%, at least 90%, at least 95%, or at least 98% identity thereto; and the second receptor comprises SEQ ID NO: 174 or a sequence sharing at least 75%, at least 80%, at least 85%, at least 90%, at least 95%, or at least 98% identity thereto.

In some embodiments, the first receptor comprises SEQ ID NO: 177, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto.

In some embodiments, the first receptor comprises SEQ ID NO: 175, or a sequence sharing at least 75%, at least 80%, at least 85%, at least 90%, at least 95%, or at least 98% identity thereto; and the second receptor comprises SEQ ID NO: 174, or a sequence sharing at least 75%, at least 80%, at least 85%, at least 90%, at least 95%, or at least 98% identity thereto.

In some embodiments, the first receptor comprises SEQ ID NO: 175, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto.

In some embodiments, the first receptor comprises SEQ ID NO: 176, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto.

In some embodiments, the first receptor comprises SEQ ID NO: 176, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto.

In some embodiments, the immune cell further comprises a T2A self-cleaving peptide, wherein the T2A self-cleaving peptide comprises SEQ ID NO: 178, or a sequence sharing at least 75%, at least 80%, at least 85%, at least 90%, at least 95%, or at least 98% identity thereto.

In some embodiments, the immune cell further comprises an interfering RNA, wherein the interfering RNA comprises SEQ ID NO: 179, or a sequence sharing at least 75%, at least 80%, at least 85%, at least 90%, at least 95%, or at least 98% identity thereto.

In some embodiments, the immune cell is autologous. In some embodiments, the immune cell is allogeneic.

In one aspect, the disclosure provides a pharmaceutical composition, comprising a therapeutically effective amount of the immune cells described herein. In some embodiments, the immune cell expresses both the first receptor and the second receptor. In some embodiments, at least about 50%, about 55%, about 60%, about 65%, about 70%, about 75%, about 80%, about 85%, about 90%, or about 95% of the immune cells express both the first receptor and the second receptor. In some embodiments, at least 90% of the immune cells express both the first receptor and the second receptor. In some embodiments, the pharmaceutical composition further comprises a pharmaceutically acceptable carrier, diluent or excipient. In some embodiments, the pharmaceutical composition described herein is for use as a medicament in the treatment of EGFR+ cancer.

In one aspect, the disclosure provides a polynucleotide or polynucleotide system, comprising one or more polynucleotides comprising polynucleotide sequences encoding: a.) a first receptor, comprising an extracellular ligand binding domain specific to Endothelial Growth Factor Receptor (EGFR); and b.) a second receptor, comprising an extracellular ligand binding domain specific to a non-target antigen that has been lost in the EGFR+ cancer cell due to loss of heterozygosity, wherein the first receptor is an activator receptor responsive to EGFR on the EGFR+ cancer cell; and wherein the second receptor is an inhibitory receptor responsive to the non-target antigen.

In one aspect, the disclosure provides a polynucleotide or polynucleotide system, comprising one or more polynucleotides comprising polynucleotide sequences encoding the first receptor and the second receptor for use in generating the immune cells described herein.

In some embodiments of the polynucleotide or polynucleotide system of the disclosure, the polynucleotide or polynucleotide system comprises a sequence encoding an shRNA specific to B2M. In some embodiments, the sequences encoding the first receptor, the second receptor, and the shRNA specific to B2M are encoded by the same polynucleotide.

In one aspect, the disclosure provides a vector, comprising the one or more polynucleotides described herein.

In one aspect, the disclosure provides a method of killing EGFR+ cancer cell having loss of heterozygosity at an MHC class I locus, comprising administering to the subject an effective amount of the immune cell described herein or the pharmaceutical composition described herein.

In some embodiments, the EGFR+ cancer cell is a lung cancer cell, a small cell lung cancer cell, a non-small cell lung cancer cell, a pancreatic ductal carcinoma cell, a colorectal cancer cell, a head and neck cancer cell, a esophagus and gastric adenocarcinoma cell, an ovarian cancer cell, a glioblastoma multiforme cell, a cervical squamous cell carcinoma cell, a kidney cancer cell, a papillary kidney cancer cell, a kidney renal clear cell carcinoma cell, a bladder cancer cell, a breast cancer cell, a bile duct cancer cell, a liver cancer cell, a prostate cancer cell, a sarcoma cell, a thyroid cancer cell, a thymus cancer cell, a stomach cancer cell, or a uterine cancer cell. In some embodiments, the EGFR+ cancer cell is a lung cancer cell.

In some embodiments, the EGFR+ cancer cell is an EGFR+/HLA-A*02− cancer cell that does not express HLA-A*02; or a cancer cell derived from an HLA-A*02+ individual which does not express HLA-A*02. In some embodiments, the EGFR+/HLA-A*02− cancer cell is derived from an EGFR+/HLA-A*02+ cell by loss of heterozygosity at HLA-A leading to loss of HLA-A*02.

In one aspect, the disclosure provides a method of treating EGFR+ cancer in a subject having an EGFR+ tumor having loss of heterozygosity at a locus encoding a non-target antigen, comprising administering to the subject an effective amount of the immune cell described herein or the pharmaceutical composition described herein.

In some embodiments, the subject is a heterozygous HLA-A*02 patient with a malignancy that expresses EGFR and has lost HLA-A*02 expression.

In some embodiments, the subject is a heterozygous HLA-A*02 patient with recurrent unresectable or metastatic solid tumors that express EGFR and have lost HLA-A*02 expression.

In one aspect, the disclosure provides a method of treating a cancer in a subject comprising: a.) determining the genotype or expression level of a non-target antigen in non-malignant cells and cancer cells of the subject; b.) determining the expression level of EGFR in cancer cells of the subject; and c.) administering to the subject an effective amount of the immune cell described herein or the pharmaceutical composition described herein if the non-malignant cells express the non-target antigen and the cancer cells do not express the non-target antigen, and the cancer cells are EGFR positive.

In some embodiments, administration of the immune cell described herein or the pharmaceutical composition described herein reduces the size of a tumor in the subject.

In some embodiments, the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%. In some embodiments, the tumor is eliminated.

In some embodiments, administration of the immune cell or the pharmaceutical composition arrests the growth of a tumor in the subject. In some embodiments, administration of the immune cell described herein or the pharmaceutical composition described herein reduces the number of tumors in the subject.

In some embodiments, administration of the immune cell or the pharmaceutical composition results in selective killing of a cancer cell but not a normal cell in the subject. In some embodiments, at least about 60% of the cells killed are cancer cells, at least about 65% of the cells killed are cancer cells, at least about 70% of the cells killed are cancer cells, at least about 75% of the cells killed are cancer cells, at least about 80% of the cells killed are cancer cells, at least about 85% of the cells killed are cancer cells, at least about 90% of the cells killed are cancer cells, at least about 95% of the cells killed are cancer cells, or about 100% of the cells killed are cancer cells.

In some embodiments, administration of the immune cell or pharmaceutical composition results in the killing of about 40%, about 50%, about 60%, about 70%, about 80%, about 90% or all of the cancer cells of the subject. In some embodiments, the cancer cell comprises a lung cancer cell, a small cell lung cancer cell, a non-small cell lung cancer cell, a pancreatic ductal carcinoma cell, a colorectal cancer cell, a head and neck cancer cell, a esophagus and gastric adenocarcinoma cell, an ovarian cancer cell, a glioblastoma multiforme cell, a cervical squamous cell carcinoma cell, a kidney cancer cell, a papillary kidney cancer cell, a kidney renal clear cell carcinoma cell, a bladder cancer cell, a breast cancer cell, a bile duct cancer cell, a liver cancer cell, a prostate cancer cell, a sarcoma cell, a thyroid cancer cell, a thymus cancer cell, a stomach cancer cell, or a uterine cancer cell. In some embodiments, administration of the immune cell or the pharmaceutical composition results in fewer side effects for the subject than administration of an otherwise equivalent immune cell comprising the first activator receptor but no second inhibitory receptor.

In one aspect, the disclosure provides a method of making a plurality of immune cells, comprising: a.) providing a plurality of immune cells, and b.) transforming the plurality of immune cells with the polynucleotide system described herein, or the vector described herein.

In one aspect, the disclosure provides a kit comprising the immune cell described herein or the pharmaceutical composition described herein. In some embodiments, the kit further comprises instructions for use.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 3A shows EGFR CAR activation of Jurkat cells expressing an EGFR CAR, when co-cultured HCT116 target cells.

FIG. 3B shows that EGFR CAR activation of Jurkat cells can be blocked by an HLA-A*02 LIR-1 inhibitory receptor. Co-expression of the EGFR CAR and HLA-A*02 LIR-1 inhibitory receptor by Jurkat cells leads to a shift in the CAR $E_{MAX}$ of approximately 1.8x when Jurkat cells are presented with HCT116 target cells expressing EGFR and HLA-A*02.

FIG. 20B shows the molecule/cell sensitivity (IC50) of the inhibitory receptor with HLA-A*11 #4.

DETAILED DESCRIPTION

Figure 1A:
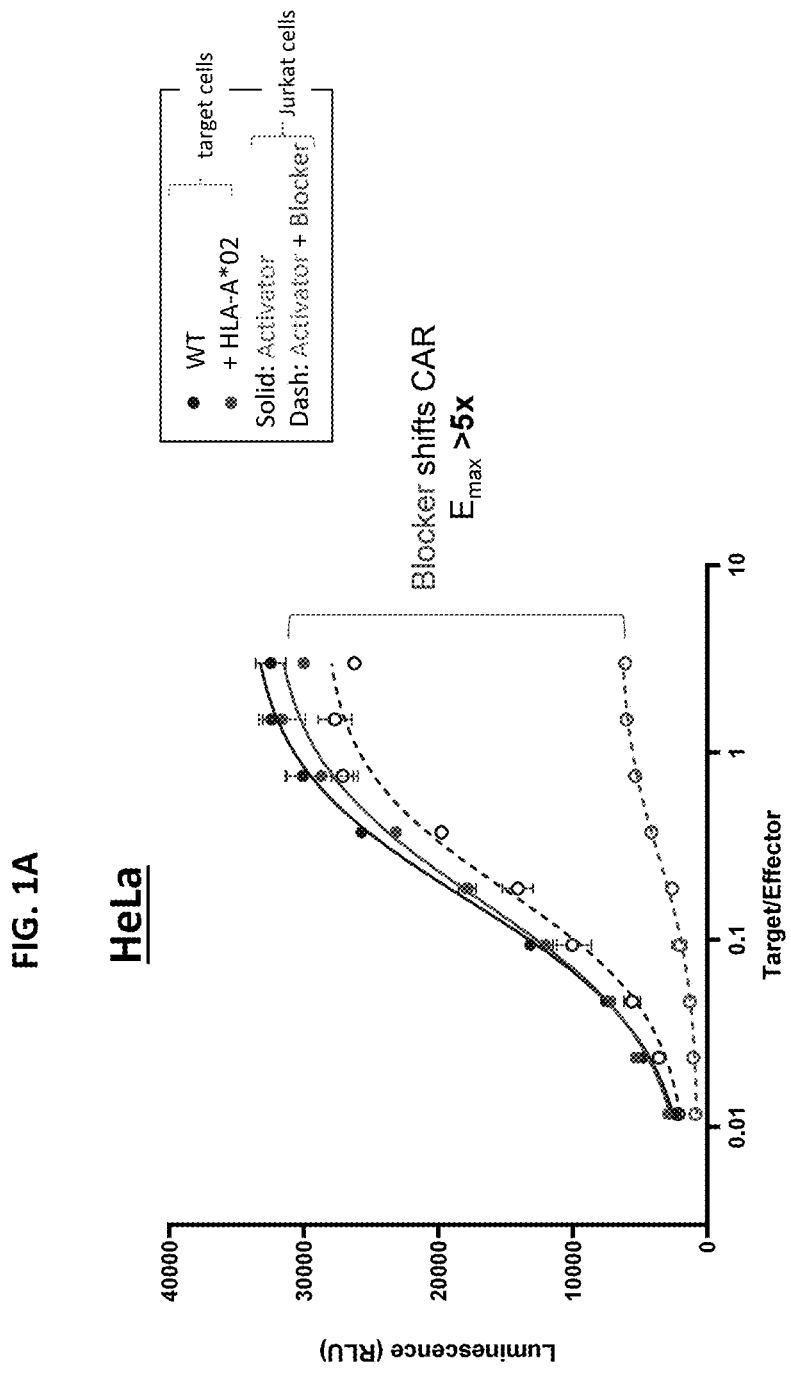
FIG. 1A is a plot showing that Jurkat cells expressing an EGFR CAR activator and an HLA-A*02 LIR-1 blocker are activated by EGFR+/HLA-A*02− HeLa target cells but not EGFR+/HLA-A*02+ HeLa target cells.

Provided herein are compositions and methods for treating cancers using immune cells comprising a two receptor system responsive to differences in gene expression of a ligand between cancer and normal cells. These differences in expression can be due to loss of heterozygosity in the cancer cells. Alternatively, the differences in expression can be because the gene expression is not expressed in cancer cells, or is expressed in cancer cells at a lower level than normal cells. The two-receptor system is expressed in immune cells, for example immune cells used in adoptive cell therapy, and targets activity of these immune cells to cancer cells exhibiting loss of heterozygosity or expression differences. In this two receptor system, the first receptor (an activator receptor, sometimes referred to herein as an A module) activates, or promote activation of the immune cells, while the second receptor (an inhibitory receptor, sometimes referred to herein as a blocker, or inhibitor receptor, or a B module) acts to inhibit activation of the immune cells by the first receptor. Each receptor contains a ligand-binding domain (LBD) that binds a specific ligand. Signals from the two receptors upon ligand binding are integrated by the immune cell. Differential expression of ligands for the first and second receptors in cancer and normal cells, for example through loss of heterozygosity of the locus encoding the inhibitory ligand in cancer cells, or differences in transcription levels, mediates activation of immune cells by target cancer cells that express the first activator ligand but not the second inhibitory ligand.

In particular embodiments of the compositions and methods provided herein, immune cells comprising the two receptor system described herein are used to treat epidermal growth factor receptor (EGFR) positive cancers. This includes lung cancers, glioblastoma, breast cancers, head and neck cancer and colorectal cancers. In the case of EGFR-positive cancers, the target antigen of the activator receptor is EGFR, or a peptide antigen thereof, in a complex with a major histocompatibility complex class I (MHC-I). EGFR is expressed in a wide variety of normal tissues, such as epithelial, mesenchymal and neuronal tissues, and plays a major role in normal cellular processes such as cellular proliferation and differentiation, as well as development. Because of its expression in certain tumors, EGFR is an attractive tumor-specific antigen that could mediate selective killing of EGFR+ tumors if these cancer cells could be specifically targeted with an appropriate therapeutic. However, normal EGFR expression in non-cancer (non-target) cells has prevented the effective use of EGFR for targeted therapies such as adoptive cell therapies. Skin and gastrointestinal toxicities have prevented effective targeting of EGFR in EGFR positive cancers. By pairing an EGFR activator receptor with an inhibitory receptor, the methods provided herein increase the specificity of EGFR targeted adoptive cell therapies and decrease harmful effects associated with these therapies, such as dose-limited toxicity.

In some embodiments, the ligand for the activator is an EGFR peptide complexed with MHC class I. In the methods described herein, this EGFR targeted activator receptor is paired with an inhibitory receptor, which increases the safety window of the activator by blocking its cytolytic effect on normal EGFR-positive tissues. However, the activator receptor still directs the targeted killing of tumor cells by immune cells comprising the two-receptor system, as the tumor cells do not express the ligand for the inhibitor, or blocker, receptor. The target for the second, inhibitory receptor is expressed by EGFR positive tissues such as epithelial tissues, but is not expressed in cancer cells, and the inhibitory receptor recognizes this "non-target antigen" as an inhibitory stimulus. An exemplary target for the second inhibitory receptor is expressed by lung epithelial tissue, and is lost from EGFR positive cancer cells due to heterozygosity (LOH), leaving a single allelic form in cancer cells that can be distinguished from other alleles via an allele-specific ligand binding domain on the inhibitory receptor. Exemplary targets of the inhibitory receptor include, but are not limited to, Major Histocompatibility Complex (MHC) proteins such as human leukocyte antigen A (HLA-A). HLA-B, HLA-C, and other HLAs. HLAs are encoding by variant genes, such as HLA-A*01, HLA-A*02, HLA*A03, HLA-C*07, and others, which can be lost from EGFR positive cancer cells through loss of heterozygosity. Alternatively, further exemplary targets of the inhibitory receptor include collectin subfamily member 12 COLEC12, APC down-regulated 1 (APCDD1) and C-X-C motif chemokine ligand 16 (CXCL16). Each of these has a common nonsynonymous variant form, with the amino-acid alteration in its extracellular domain accessible to antibodies, which can be used as a B module target for a cellular integrator designed to safely treat patients with EGFR positive cancers with engineered T cells activated by an activator receptor such as a EGFR or EGFR pMHC responsive activator receptor. The compositions and methods of the disclosure can reduce or eliminate DLT caused by expression of EGFR by normal tissue. The disclosure provides methods of targeting EGFR in cancer cells to treat EGFR positive cancers using adoptive cell therapies by adding a second inhibitory receptor that blocks activation of the adoptive immune cells in the presence of a second ligand (a ligand other than EGFR, termed a "non-target antigen"). Using the compositions and methods described herein, tumor cells that express EGFR are attacked by the adoptive immune cells expressing the two receptors because these tumor cells express only the activator ligand, EGFR. In contrast, normal cells that express EGFR plus the non-target antigen (alternatively termed a "blocker antigen") are protected from the adoptive immune cells. The inhibitory receptor response to the non-target antigen on normal cells and thereby prevents activation of immune cells by the EGFR-targeted activator receptor. This dual-targeting approach creates the therapeutic window that will allow an EGFR-directed cell therapy to be dosed safely and effectively in EGFR-positive cancer patients.

The disclosure provides methods and compositions that allow the use of potent EGFR CAR and TCRs that induce on-target toxicity, and renders these EGFR targeted receptors useful as a therapeutic by mitigating their toxicity.

In variations, the compositions and methods described herein may be used to kill target cells and/or treat subjects in which expression of the non-target antigen is partially or completely decreased by causes other than loss of heterozygosity, including but not limited to partial gene deletion, epigenetic silence, point mutations, truncations.

Definitions

Prior to setting forth this disclosure in more detail, it may be helpful to an understanding thereof to provide definitions of certain terms to be used herein.

Unless defined otherwise, all technical and scientific terms used herein have the same meaning as commonly understood by those of ordinary skill in the art to which the disclosure belongs. Although any methods and materials similar or equivalent to those described herein can be used in the practice or testing of particular embodiments, preferred embodiments of compositions, methods and materials are described herein. For the purposes of the present disclosure, the following terms are defined below. Additional definitions are set forth throughout this disclosure.

As used herein, the term "about" or "approximately" refers to a quantity, level, value, number, frequency, percentage, dimension, size, amount, weight or length that varies by as much as 15%, 10%, 9%, 8%, 7%, 6%, 5%, 4%, 3%, 2% or 1% to a reference quantity, level, value, number, frequency, percentage, dimension, size, amount, weight or length. In one embodiment, the term "about" or "approximately" refers a range of quantity, level, value, number, frequency, percentage, dimension, size, amount, weight or length±15%, ±10%, ±9%, ±8%, 7%, 6%, ±5%, ±4%, ±3%, ±2%, or ±1% about a reference quantity, level, value, number, frequency, percentage, dimension, size, amount, weight or length.

As used herein, the term "isolated" means material that is substantially or essentially free from components that normally accompany it in its native state. In particular embodiments, the term "obtained" or "derived" is used synonymously with isolated.

The terms "subject," "patient" and "individual" are used interchangeably herein to refer to a vertebrate, preferably a mammal, more preferably a human. Tissues, cells, and their progeny of a biological entity obtained in vivo or cultured in vitro are also encompassed. A "subject," "patient" or "individual" as used herein, includes any animal that exhibits pain that can be treated with the vectors, compositions, and methods contemplated herein. Suitable subjects (e.g., patients) include laboratory animals (such as mouse, rat, rabbit, or guinea pig), farm animals, and domestic animals or pets (such as a cat or dog). Non-human primates and, preferably, human patients, are included.

As used herein "treatment" or "treating," includes any beneficial or desirable effect, and may include even minimal improvement in symptoms. "Treatment" does not necessarily indicate complete eradication or cure of the disease or condition, or associated symptoms thereof.

As used herein, "prevent," and similar words such as "prevented," "preventing" etc., indicate an approach for preventing, inhibiting, or reducing the likelihood of a symptom of disease. It also refers to delaying the onset or recurrence of a disease or condition or delaying the occurrence or recurrence of the symptoms of a disease. As used herein, "prevention" and similar words also includes reducing the intensity, effect, symptoms and/or burden of disease prior to onset or recurrence.

As used herein, the term "amount" refers to "an amount effective" or "an effective amount" of a virus to achieve a beneficial or desired prophylactic or therapeutic result, including clinical results.

A "therapeutically effective amount" of a virus or cell may vary according to factors such as the disease state, age, sex, and weight of the individual, and the ability of the virus or cell to elicit a desired response in the individual. A therapeutically effective amount is also one in which any toxic or detrimental effects of the virus or cell are outweighed by the therapeutically beneficial effects. The term "therapeutically effective amount" includes an amount that is effective to "treat" a subject (e.g., a patient).

An "increased" or "enhanced" amount of a physiological response, e.g., electrophysiological activity or cellular activity, is typically a "statistically significant" amount, and may include an increase that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

A "decreased" or "reduced" amount of a physiological response, e.g., electrophysiological activity or cellular activity, is typically a "statistically significant" amount, and may include a decrease that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

By "maintain," or "preserve," or "maintenance," or "no change," or "no substantial change," or "no substantial decrease" refers generally to a physiological response that is comparable to a response caused by either vehicle, or a control molecule/composition. A comparable response is one that is not significantly different or measurable different from the reference response.

In general, "sequence identity" or "sequence homology" refers to an exact nucleotide-to-nucleotide or amino acid-to-amino acid correspondence of two polynucleotides or polypeptide sequences, respectively. Typically, techniques for determining sequence identity include determining the nucleotide sequence of a polynucleotide and/or determining the amino acid sequence encoded thereby, and comparing these sequences to a second nucleotide or amino acid sequence. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin And Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (generally nucleotides or amino acids), divided by the total number of symbols in the shorter of the two sequences. The program may be used to determine percent identity over the entire length of the proteins being compared. Default parameters are provided to optimize searches with short query sequences in, for example, with the blastp program. The program also allows use of an SEG filter to mask-off segments of the query sequences as determined by the SEG program of Wootton and Federhen, Computers and Chemistry 17:149-163 (1993). Ranges of desired degrees of sequence identity are approximately 80% to 100% and integer values therebetween. Typically, the percent identities between a disclosed sequence and a claimed sequence are at least 80%, at least 85%, at least 90%, at least 95%, or at least 98%.

As used herein, a "polynucleotide system" refers to one or more polynucleotides. The one or more polynucleotides may be designed to work in concert for a particular application, or to produce a desired transformed cell.

The term "exogenous" is used herein to refer to any molecule, including nucleic acids, protein or peptides, small molecular compounds, and the like that originate from outside the organism. In contrast, the term "endogenous" refers to any molecule that originates from inside the organism (i.e., naturally produced by the organism).

The term "MOI" is used herein to refer to multiplicity of infection, which is the ratio of agents (e.g. viral particles) to infection targets (e.g. cells).

In the present description, any concentration range, percentage range, ratio range, or integer range is to be understood to include the value of any integer within the recited range and, when appropriate, fractions thereof (such as one tenth and one hundredth of an integer), unless otherwise indicated.

As used herein, a "target cell" refers to cell that is targeted by an adoptive cell therapy. For example, a target cell can be cancer cell, which can be killed by the transplanted T cells of the adoptive cell therapy. Target cells of the disclosure express a target antigen, as described herein, and do not express a non-target antigen.

As used herein, a "non-target cell" refers to cell that is not targeted by an adoptive cell therapy. For example, in an adoptive cell targeting cancer cells, normal, healthy, non-cancerous cells are non-target cells. Some, or all, non-target cells in a subject may express both the target antigen and the non-target antigen. Non-target cells in a subject may express the non-target antigen irrespective of whether or not these cells also express the target antigen.

As used herein, a "target antigen," whether referred to using the term antigen or the name of a specific antigen, refers to an antigen expressed by a target cell, such as a cancer cell. Expression of target antigen is not limited to target cells. Target antigens may be expressed by both cancer cells and normal, non-cancer cells in a subject.

As used herein, a "non-target antigen" (or "blocker antigen") whether referred to using the term antigen or the name of a specific antigen, refers to an antigen that is expressed by normal, non-cancer cells and is not expressed in cancer cells. This difference in expression allows the inhibitory receptor to inhibit immune cell activation in the presence of non-target cells, but not in the presence of target cells.

Polymorphism refers to the presence of two or more variants of a nucleotide sequence in a population. A polymorphism may comprise one or more base changes, an insertion, a repeat, or a deletion. A polymorphism includes e.g. a simple sequence repeat (SSR) and a single nucleotide polymorphism (SNP), which is a variation, occurring when a single nucleotide of adenine (A), thymine (T), cytosine (C) or guanine (G) is altered.

As used herein, "affinity" refers to strength of binding of a ligand to a single ligand binding site on a receptor, for example an antigen for the antigen binding domain of any of the receptors described herein. Ligand binding domains can have a weaker interaction (low affinity) with their ligand, or a stronger interaction (high affinity).

Kd, or dissociation constant, is a type of equilibrium constant that measures the propensity of a larger object to separate reversibly into smaller components, such as, for example, when a macromolecular complex comprising receptor and its cognate ligand separates into the ligand and the receptor. When the Kd is high, it means that a high concentration of ligand is need to occupy the receptor, and the affinity of the receptor for the ligand is low. Conversely, a low Kd means that the ligand has a high affinity for the receptor.

As used herein, a receptor that is "responsive" or "responsive to" refers to a receptor comprising an intracellular domain, that when bound by a ligand (i.e. antigen) generates a signal corresponding to the known function of the intracellular domain. An activator receptor bound to a target antigen can generate a signal that causes activation of an immune cell expressing the activator receptor. An inhibitory receptor bound to a non-target antigen can generate an inhibitory signal that prevents or reduces activation of an immune cell expressing the activator receptor. Responsiveness of receptors, and their ability to activate or inhibit immune cells expressing the receptors, can be assayed by any means known in the art and described herein, including, but not limited to, reporter assays and cytotoxicity assays.

As used herein, "activation" of an immune cell or an immune cell that is "activated" is an immune cell that can carry out one or more functions characteristic of an immune response. These functions include proliferation, release of cytokines, and cytotoxicity, i.e. killing of a target cell. Activated immune cells express markers that will be apparent to persons of skill in the art. For example, activated T cells can express one or more of CD69, CD71, CD25 and FILA-DR. An immune cell expressing an activator receptor (e.g. an EGFR CAR) can be activated by the activator receptor when it becomes responsive to the binding of a target antigen (e.g. EGFR). A "target antigen" can also be referred to as an "activator antigen" and may be isolated or expressed by a target cell. Activation of an immune cell expressing an inhibitory receptor can be reduced or prevented when the inhibitory receptor becomes responsive to the binding of a non-target antigen (e.g. HLA-A*02), even when the activator receptor is bound to the target activator ligand. A "non-target antigen" can also be referred to as an "inhibitory ligand" or a "blocker", and may be isolated or expressed by a target cell.

Receptor expression on an immune cell can be verified by assays that report the presence of the activator receptors and inhibitory receptors described herein. For example, a population of immune cells can be stained with a labeled molecule (e.g. a fluorophore labeled receptor-specific antibody or a fluorophore-labeled receptor-specific ligand), and quantified using fluorescence activated cell sorting (FACS) flow cytometry. This method allows a percentage of immune cells in a population of immune cells to be characterized as expressing an activator receptor, an inhibitory receptor, or both receptors. The ratio of activator receptor and inhibitory receptors expressed by the immune cells described herein can be determined by, for example, digital droplet PCR. These approaches can be used to characterize the population of cells for the production and manufacturing of the immune cells, pharmaceutical compositions, and kits described herein. For the immune cells, pharmaceutical compositions, and kits described herein, it is understood that a suitable percentage of immune cells expressing both an activator receptor and an inhibitory receptor is determined specifically for the methods described herein. For example, a suitable percentage of immune cells expressing both an activator receptor and in inhibitory receptor can be at least 50%, at least 55%, at least 60%, at least 65%, at least 70%, at least 75%, at least 80%, at least 85%, at least 90%, or at least 95%. For example, a suitable percentage of immune cells expressing both an activator receptor and in inhibitory receptor can be at most 50%, at most 55%, at most 60%, at most 65%, at most 70%, at most 75%, at most 80%, at most 85%, at most 90%, or at most 95%. For example, a suitable ratio of activator receptor and inhibitory receptor in an immune cell can be about 5:1, about 4:1, about 3:1, about 2:1, about 1:1, about 1:2, about 1:3, about 1:4, or about 1:5. It is understood that purification, enrichment, and/or depletion steps can be used on populations of immune cells to meet suitable values for the immune cells, pharmaceutical compositions, and kits described herein.

A responsive receptor expressed by the immune cells described herein can be verified by assays that measure the generation of a signal expected to be generated by the intracellular domain of the receptor. Reporter cell lines, such as Jurkat-Luciferase NFAT cells (Jurkat cells), can be used to characterize a responsive receptor. Jurkat cells are derived from T cells and comprise a stably integrated nuclear factor of activated T-cells (NFAT)-inducible luciferase reporter system. NFAT is a family of transcription factors required for immune cell activation, whose activation can be used as a signaling marker for T cell activation. Jurkat cells can be transduced or transfected with the activator receptors and/or inhibitory receptors described herein. The activator receptor is responsive to the binding of a ligand if the Jurkat cell expresses a luciferase reporter gene, and the level of responsiveness can be determined by the level of reporter gene expression. The presence of luciferase can be determined using any known luciferase detection reagent, such as luciferin. An inhibitory receptor is responsive to the binding of a ligand if, when co-expressed with an activator receptor in Jurkat cells, it prevents a normally responsive immune cell from expressing luciferase in response to the activator receptor. For example, the responsiveness of an inhibitory receptor can be determined and quantified in a Jurkat cell expressing both an activator and an inhibitor by observing the following: 1) the Jurkat cell expresses luciferase in the presence of activator receptor ligand and absence of inhibitory receptor ligand; and 2) luciferase expression in the Jurkat cell is reduced or eliminated in the presence of both an activator receptor ligand and an inhibitory receptor ligand. This approach can be used to determine the sensitivity, potency, and selectivity of activator receptors and specific pairs of activator receptors and inhibitory receptors. The sensitivity, potency, and selectivity can be quantified by EC50 or IC50 values using dose-response experiments, where an activator receptor ligand and/or inhibitory receptor ligand is titrated into a culture of Jurkat cells expressing an activator receptor or a specific pair of activator and inhibitory receptors. Alternatively, the EC50 and IC50 values can be determined in a co-culture of immune cells (e.g. Jurkat cells or primary immune cells) expressing an activator receptor or a specific pair of activator and inhibitory receptors and target cells expressing an increasing amount of an activator ligand or inhibitor ligand. An increasing amount of activator ligand or inhibitor ligand can be accomplished in the target cell by, for example, titration of activator ligand or inhibitor ligand encoding mRNA into target cells, or use of target cells that naturally express different levels of the target ligands. Exemplary suitable EC50 and IC50 values for the activator and inhibitory receptors as determined used target cells expressing varying amounts of the target and non-target ligands include an EC50 of 260 transcripts per million (TPM) or less for the activator receptor, for example an EC50 of between 10 and 260 TPM, and an IC50 of 10 TPM or less for the inhibitory receptor, for example an IC50 of 1-5 TPM.

Activation of the immune cells described herein that express an activator receptor or specific pairs of activator and inhibitory receptors can be further determined by assays that measure the viability of a target cell following co-incubation with said immune cells. The immune cells, sometimes referred to as effector cells, are co-incubated with target cells that express an activator receptor ligand, an inhibitory receptor ligand, or both an activator and inhibitory receptor ligand. Following co-incubation, viability of the target cell is measured using any method to measure viability in a cell culture. For example, viability can be determined using a mitochondrial function assay that uses a tetrazolium salt substrate to measure active mitochondrial enzymes. Viability can also be determined using imaging based methods. Target cells can express a fluorescent protein, such as green fluorescent protein or red fluorescent protein. Reduction in total cell fluorescence indicates a reduction in viability of the target cell. A reduction in viability of the target cell following incubation with immune cells expressing an activator receptor or a specific pair of activator and inhibitory receptors is interpreted as target cell-mediated activation of the immune cell. A measure of the selectivity of the immune cells can also be determined using this approach. The immune cell expressing a pair of activator and inhibitory receptors is selective if the following is observed: 1) viability is reduced in target cells expressing the activator receptor ligand but not the inhibitory receptor ligand; 2) viability is not reduced in target cells expressing both an activator receptor ligand and an inhibitory receptor ligand. From these measurements, a "specific killing" value can be derived that quantifies the percentage of immune cell activation based on the reduction in viability of target cell as a percentage of a negative control (immune cells that do not express an activator receptor). Further, from these measurements a "selectivity ratio" value can be derived that represents the ratio of the specific killing observed in target cells expressing an activator receptor ligand in the absence of inhibitory receptor ligand to the specific killing observed in target cells expressing both an activator receptor ligand and an inhibitory receptor ligand. This approach can be used to characterize the population of cells for the production and manufacturing of the immune cells, pharmaceutical compositions, and kits described herein. A suitable specific killing value for the immune cells, pharmaceutical compositions, and kits can be, for example, the following criteria: 1) at least 50% specific killing following a 48 hour co-incubation of immune cells and target cells expressing activator receptor ligand in the absence of inhibitory receptor ligand; 2) less than or equal to 20% specific killing of target cell expressing both an activator receptor ligand and an inhibitory receptor ligand. As a further example, the immune cells are capable of killing at least 30%, at least 40%, at least 50%, at least 60%, at least 70%, at least 80%, at least 90%, at least 95%, at least 97% or at least 99% of target cells expressing the activator ligand and not the inhibitor ligand over a period of 6 hours, 12 hours, 18 hours, 24 hours, 30 hours, 36 hours, 42 hours, 48 hours, 54 hours, or 60 hours, while killing less than 40%, less than 30%, less than 20%, less than 10%, less than 5%, less than 3% or less than 1% of target cells expressing the activator and inhibitor ligands over the same time period.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

As used herein, the term "functional variant" refers to a protein that has one or more amino-acid substitutions, insertions, or deletions as compared to a parental protein, and which retains one or more desired activities of the parental protein. A functional variant may be a fragment of the protein (i.e. a variant having N- and/or C-terminal deletions) that retain the one or more desired activities of the parental protein.

As used herein, a "non-target allelic variant" refers to an allele of a gene whose product is expressed by non-target cells, but is not expressed by target cells. For example, a non-target allelic variant is an allele of a gene that is expressed by normal, non-cancer cells of subject, but not expressed by cancer cells of the subject. The expression of the non-target allelic variant can be lost in the cancer cells by any mechanism, including, but not limited to, loss of heterozygosity, mutation, or epigenetic modification of the gene encoding the non-target allelic variant.

As used herein, "specific to" or "specifically binds to" when used with respect to a ligand binding domain, such as an antigen binding domain, refers to a ligand binding domain that has a high specificity for a named target. Antibody specificity can viewed as a measure of the goodness of fit between the ligand binding domain and the corresponding ligand, or the ability of the ligand binding domain to discriminate between similar or even dissimilar ligands. In comparison with specificity, affinity is a measure of the strength of the binding between the ligand binding domain and ligand, such that a low-affinity ligand binding domain binds weakly and high-affinity ligand binding domain binds firmly. A ligand binding domain that is specific to a target allele is one that can discriminate between different alleles of a gene. For example, a ligand binding domain that is specific to HLA-A*02 will not bind, or bind only weakly to, other HLA-A alleles such as HLA-A*01 or HLA-A*03. In the context of the activator and inhibitory receptors described herein, the ligand binding domain mediates specific activation or inhibition of the immune cell response. The person of skill in the art will appreciate that a ligand binding domain can be said to be specific to a particular target, and yet still have low levels of binding to one or more additional targets that do not affect its function in the receptor systems described herein.

All publications and patents mentioned herein are hereby incorporated by reference in their entirety as if each individual publication or patent was specifically and individually indicated to be incorporated by reference. In case of conflict, the present application, including any definitions herein, will control. However, mention of any reference, article, publication, patent, patent publication, and patent application cited herein is not, and should not be taken as an acknowledgment, or any form of suggestion, that they constitute valid prior art or form part of the common general knowledge in any country in the world.

Activator Receptors

The disclosure provides a first receptor, comprising a first extracellular ligand binding domain specific to a target antigen comprising a cancer cell-specific antigen, or a peptide antigen thereof in a complex with a major histocompatibility complex class I (MHC-I). The first receptor is an activator receptor, and mediates activation of an immune cell expressing the first receptor upon binding of the target antigen by the extracellular ligand binding domain of the first receptor. The first receptor is responsive to a target antigen (i.e. activator ligand). For example, when a target antigen binds to or contacts the first receptor, the first receptor is responsive and activates an immune cell expressing the first receptor upon binding of the target antigen by the extracellular ligand binding domain of the first receptor. In some embodiments, the first receptor is a chimeric antigen receptor (CAR). In some embodiments, the first receptor is a T cell receptor (TCR).

In some embodiments, the first receptor is humanized. As used herein, "humanized" refers to the replacement of a sequence or a subsequence in a transgene that has been isolated or derived from a non-human species with a homologous, or functionally equivalent, human sequence. For example, a humanized antibody can be created by grafting mouse CDRs into human framework sequences, followed by back substitution of certain human framework residues for the corresponding mouse residues from the source antibody.

Activator Targets

According to the present disclosure, the target antigen for the first receptor is epidermal growth factor receptor (EGFR), or a peptide antigen of EGFR in a complex with a major histocompatibility complex class I (MHC-I).

The major histocompatibility complex class I (MHC-I) is a protein complex that displays antigens to cells of the immune system, triggering an immune response. The Human Leukocyte Antigens (HLAs) corresponding to MHC-I are HLA-A, HLA-B and HLA-C.

Cancer cell-specific pMHC antigens comprising any of HLA-A, HLA-B, HLA-C, HLA-E, HLA-F or HLA-G are envisaged as within the scope of the disclosure. In some embodiments, the cancer cell-specific antigen comprises HLA-A. HLA-A receptors are heterodimers comprising a heavy α chain and smaller p chain. The α chain is encoded by a variant of HLA-A, while the β chain (β2-microglobulin) is an invariant. There are several thousand variant HLA-A genes, all of which fall within the scope of the instant disclosure. In some embodiments, the MHC-I comprises a human leukocyte antigen A*02 allele (HLA-A*02).

In some embodiments, the cancer cell-specific antigen comprises HLA-B. Hundreds of versions (alleles) of the HLA-B gene are known, each of which is given a particular number (such as HLA-B27).

In some embodiments, the cancer cell-specific antigen comprises HLA-C. HLA-C belongs to the HLA class I heavy chain paralogues. This class I molecule is a heterodimer consisting of a heavy chain and a light chain (beta-2 microglobulin). Over one hundred HLA-C alleles are known in the art.

In some embodiments, the cancer cell-specific antigen is a lung cancer antigen, a glioblastoma antigen, a breast cancer antigen, a head and neck cancer antigen or a colorectal cancer antigen. In some embodiments, the cancer cell-specific antigen is a colorectal cancer antigen. In some embodiments, the cancer cell-specific antigen is EGFR or a peptide antigen thereof.

In some embodiments, the cancer cell-specific antigen is EGFR, or a peptide antigen thereof in a complex with a major histocompatibility complex class I (MHC-I). EGFR is a transmembrane protein that is receptor form members of the epidermal growth factor (EGF) family of extracellular protein ligands. EGFR is widely expressed in normal tissues, such as mesenchymal, epithelial and neuronal tissues, and plays an important role in cell proliferation, differentiation, and development. EGFR is also highly expressed in a variety of solid tumors, and EGFR expression correlates with tumor progression, resistance to chemotherapy, and poor prognosis.

All isoforms of EGFR and clinically relevant mutations of EGFR (e.g. EGFRvIII, S468/492R) are envisaged as cancer cell-specific antigens of the disclosure. EGFR isoform a is described in NCBI record number NP_005219.2, the contents of which are incorporated by reference herein. In some embodiments, EGFR comprises an amino acid sequence of:

```
                                                                  (SEQ ID NO: 1)
  1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QEILHGAVRF SNNPALCNVE SIQWRDIVSS DFLSNMSMDF

181 QNHLGSCQKC DPSCPNGSCW GAGEENCQKL TKIICAQQCS GRCRGKSPSD CCHNQCAAGC

241 TGPRESDCLV CRKFRDEATC KDTCPPLMLY NPTTYQMDVN PEGKYSFGAT CVKKCPRNYV

301 VTDHGSCVRA CGADSYEMEE DGVRKCKKCE GPCRKVCNGI GIGEFKDSLS INATNIKHFK

361 NCTSISGDLH ILPVAFRGDS FTHTPPLDPQ ELDILKTVKE ITGFLLIQAW PENRTDLHAF

421 ENLEIIRGRT KQHGQFSLAV VSLNITSLGL RSLKEISDGD VIISGNKNLC YANTINWKKL
```

```
 481 FGTSGQKTKI ISNRGENSCK ATGQVCHALC SPEGCWGPEP RDCVSCRNVS RGRECVDKCN

541 LLEGEPREFV ENSECIQCHP ECLPQAMNIT CTGRGPDNCI QCAHYIDGPH CVKTCPAGVM

601 GENNTLVWKY ADAGHVCHLC HPNCTYGCTG PGLEGCPTNG PKIPSIATGM VGALLLLLVV

661 ALGIGLFMRR RHIVRKRTLR RLLQERELVE PLTPSGEAPN QALLRILKET EFKKIKVLGS

721 GAFGTVYKGL WIPEGEKVKI PVAIKELREA TSPKANKEIL DEAYVMASVD NPHVCRLLGI

781 CLTSTVQLIT QLMPFGCLLD YVREHKDNIG SQYLLNWCVQ IAKGMNYLED RRLVHRDLAA

841 RNVLVKTPQH VKITDFGLAK LLGAEEKEYH AEGGKVPIKW MALESILHRI YTHQSDVWSY

901 GVTVWELMTF GSKPYDGIPA SEISSILEKG ERLPQPPICT IDVYMIMVKC WMIDADSRPK

961 FRELIIEFSK MARDPQRYLV IQGDERMHLP SPTDSNEYRA LMDEEDMDDV VDADEYLIPQ

1021 QGFFSSPSTS RTPLLSSLSA TSNNSTVACI DRNGLQSCPI KEDSFLQRYS SDPTGALTED

1081 SIDDTFLPVP EYINQSVPKR PAGSVQNPVY HNQPLNPAPS RDPHYQDPHS TAVGNPEYLN

1141 TVQPTCVNST FDSPAHWAQK GSHQISLDNP DYQQDFFPKE AKPNGIFKGS TAENAEYLRV

1201 APQSSEFIGA.
```

EGFR isoform b is described in NCBI record number NP_958439.1, the contents of which are incorporated by reference herein. In some embodiments, EGFR comprises an amino acid sequence of

```
                                                              (SEQ ID NO: 2)
  1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QEILHGAVRF SNNPALCNVE SIQWRDIVSS DFLSNMSMDF

181 QNHLGSCQKC DPSCPNGSCW GAGEENCQKL TKIICAQQCS GRCRGKSPSD CCHNQCAAGC

241 TGPRESDCLV CRKFRDEATC KDTCPPLMLY NPTTYQMDVN PEGKYSFGAT CVKKCPRNYV

301 VTDHGSCVRA CGADSYEMEE DGVRKCKKCE GPCRKVCNGI GIGEFKDSLS INATNIKHFK

361 NCTSISGDLH ILPVAFRGDS FTHTPPLDPQ ELDILKTVKE ITGFLLIQAW PENRTDLHAF

421 ENLEIIRGRT KQHGQFSLAV VSLNITSLGL RSLKEISDGD VIISGNKNLC YANTINWKKL

481 FGTSGQKTKI ISNRGENSCK ATGQVCHALC SPEGCWGPEP RDCVSCRNVS RGRECVDKCN

541 LLEGEPREFV ENSECIQCHP ECLPQAMNIT CTGRGPDNCI QCAHYIDGPH CVKTCPAGVM

601 GENNTLVWKY ADAGHVCHLC HPNCTYGS.
```

EGFR isoform c is described in NCBI record number NP_958440.1, the contents of which are incorporated by reference herein. In some embodiments, EGFR comprises an amino acid sequence of:

```
                                                              (SEQ ID NO: 3)
  1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QEILHGAVRF SNNPALCNVE SIQWRDIVSS DFLSNMSMDF

181 QNHLGSCQKC DPSCPNGSCW GAGEENCQKL TKIICAQQCS GRCRGKSPSD CCHNQCAAGC

241 TGPRESDCLV CRKFRDEATC KDTCPPLMLY NPTTYQMDVN PEGKYSFGAT CVKKCPRNYV

301 VTDHGSCVRA CGADSYEMEE DGVRKCKKCE GPCRKVCNGI GIGEFKDSLS INATNIKHFK

361 NCTSISGDLH ILPVAFRGDS FTHTPPLDPQ ELDILKTVKE ITGLS.
```

EGFR isoform d is described in NCBI record number NP_958441.1, the contents of which are incorporated by reference herein. In some embodiments, EGFR comprises an amino acid sequence of:

```
                                                               (SEQ ID NO: 4)
   1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QEILHGAVRF SNNPALCNVE SIQWRDIVSS DFLSNMSMDF

181 QNHLGSCQKC DPSCPNGSCW GAGEENCQKL TKIICAQQCS GRCRGKSPSD CCHNQCAAGC

241 TGPRESDCLV CRKFRDEATC KDTCPPLMLY NPTTYQMDVN PEGKYSFGAT CVKKCPRNYV

301 VTDHGSCVRA CGADSYEMEE DGVRKCKKCE GPCRKVCNGI GIGEFKDSLS INATNIKHFK

361 NCTSISGDLH ILPVAFRGDS FTHTPPLDPQ ELDILKTVKE ITGFLLIQAW PENRTDLHAF

421 ENLEIIRGRT KQHGQFSLAV VSLNITSLGL RSLKEISDGD VIISGNKNLC YANTINWKKL

481 FGTSGQKTKI ISNRGENSCK ATGQVCHALC SPEGCWGPEP RDCVSCRNVS RGRECVDKCN

541 LLEGEPREFV ENSECIQCHP ECLPQAMNIT CTGRGPDNCI QCAHYIDGPH CVKTCPAGVM

601 GENNTLVWKY ADAGHVCHLC HPNCTYGPGN ESLKAMLFCL FKLSSCNQSN DGSVSHQSGS

661 PAAQESCLGW IPSLLPSEFQ LGWGGCSHLH AWPSASVIIT ASSCH.
```

EGFR isoform e is described in NCBI record number NP_001333826.1, the contents of which are incorporated by reference herein. In some embodiments, EGFR comprises an amino acid sequence of:

```
                                                               (SEQ ID NO: 5)
   1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QGQKCDPSCP NGSCWGAGEE NCQKLTKIIC AQQCSGRCRG

181 KSPSDCCHNQ CAAGCTGPRE SDCLVCRKFR DEATCKDTCP PLMLYNPTTY QMDVNPEGKY

241 SFGATCVKKC PRNYVVTDHG SCVRACGADS YEMEEDGVRK CKKCEGPCRK VCNGIGIGEF

301 KDSLSINATN IKHFKNCTSI SGDLHILPVA FRGDSFTHTP PLDPQELDIL KTVKEITGFL

361 LIQAWPENRT DLHAFENLEI IRGRTKQHGQ FSLAVVSLNI TSLGLRSLKE ISDGDVIISG

421 NKNLCYANTI NWKKLFGTSG QKTKIISNRG ENSCKATGQV CHALCSPEGC WGPEPRDCVS

481 CRNVSRGREC VDKCNLLEGE PREFVENSEC IQCHPECLPQ AMNITCTGRG PDNCIQCAHY

541 IDGPHCVKTC PAGVMGENNT LVWKYADAGH VCHLCHPNCT YGCTGPGLEG CPTNGPKIPS

601 IATGMVGALL LLLVVALGIG LFMRRRHIVR KRTLRRLLQE RELVEPLTPS GEAPNQALLR

661 ILKETEFKKI KVLGSGAFGT VYKGLWIPEG EKVKIPVAIK ELREATSPKA NKEILDEAYV

721 MASVDNPHVC RLLGICLTST VQLITQLMPF GCLLDYVREH KDNIGSQYLL NWCVQIAKGM

781 NYLEDRRLVH RDLAARNVLV KTPQHVKITD FGLAKLLGAE EKEYHAEGGK VPIKWMALES

841 ILHRIYTHQS DVWSYGVTVW ELMTFGSKPY DGIPASEISS ILEKGERLPQ PPICTIDVYM

901 IMVKCWMIDA DSRPKFRELI IEFSKMARDP QRYLVIQGDE RMHLPSPTDS NFYRALMDEE

961 DMDDVVDADE YLIPQQGFFS SPSTSRTPLL SSLSATSNNS TVACIDRNGL QSCPIKEDSF

1021 LQRYSSDPTG ALTEDSIDDT FLPVPGEWLV WKQSCSSTSS THSAAASLQC PSQVLPPASP

1081 EGETVADLQT Q.
```

EGFR isoform f is described in NCBI record number NP_001333827.1, the contents of which are incorporated by reference herein. In some embodiments, EGFR comprises an amino acid sequence of:

```
                                                            (SEQ ID NO: 6)
   1 MRPSGTAGAA LLALLAALCP ASRALEEKKV CQGTSNKLTQ LGTFEDHFLS LQRMFNNCEV

61 VLGNLEITYV QRNYDLSFLK TIQEVAGYVL IALNTVERIP LENLQIIRGN MYYENSYALA

121 VLSNYDANKT GLKELPMRNL QEILHGAVRF SNNPALCNVE SIQWRDIVSS DFLSNMSMDF

181 QNHLGSCQKC DPSCPNGSCW GAGEENCQKL TKIICAQQCS GRCRGKSPSD CCHNQCAAGC

241 TGPRESDCLV CRKFRDEATC KDTCPPLMLY NPTTYQMDVN PEGKYSFGAT CVKKCPRNYV

301 VTDHGSCVRA CGADSYEMEE DGVRKCKKCE GPCRKVCNGI GIGEFKDSLS INATNIKHFK

361 NCTSISGDLH ILPVAFRGDS FTHTPPLDPQ ELDILKTVKE ITGFLLIQAW PENRTDLHAF

421 ENLEIIRGRT KQHGQFSLAV VSLNITSLGL RSLKEISDGD VIISGNKNLC YANTINWKKL

481 FGTSGQKTKI ISNRGENSCK ATGQVCHALC SPEGCWGPEP RDCVSCRNVS RGRECVDKCN

541 LLEGEPREFV ENSECIQCHP ECLPQAMNIT CTGRGPDNCI QCAHYIDGPH CVKTCPAGVM

601 GENNTLVWKY ADAGHVCHLC HPNCTYGCTG PGLEGCPTNG PKIPSIATGM VGALLLLLVV

661 ALGIGLFMRR RHIVRKRTLR RLLQERELVE PLTPSGEAPN QALLRILKET EFKKIKVLGS

721 GAFGTVYKGL WIPEGEKVKI PVAIKELREA TSPKANKEIL DEAYVMASVD NPHVCRLLGI

781 CLTSTVQLIT QLMPFGCLLD YVREHKDNIG SQYLLNWCVQ IAKGMNYLED RRLVHRDLAA

841 RNVLVKTPQH VKITDFGLAK LLGAEEKEYH AEGGKVPIKW MALESILHRI YTHQSDVWSY

901 GVTVWELMTF GSKPYDGIPA SEISSILEKG ERLPQPPICT IDVYMIMVKC WMIDADSRPK

961 FRELIIEFSK MARDPQRYLV IQGDERMHLP SPIDSNEYRA LMDEEDMDDV VDADEYLIPQ

1021 QGFFSSPSTS RTPLLSSLSA TSNNSTVACI DRNGLQSCPI KEDSFLQRYS SDPTGALTED

1081 SIDDTFLPVP GEWLVWKQSC SSTSSTHSAA ASLQCPSQVL PPASPEGETV ADLQTQ.
```

EGFR isoform h is described in NCBI record number NP_001333829.1, the contents of which are incorporated by reference herein. In some embodiments, EGFR comprises an amino acid sequence of:

```
                                                            (SEQ ID NO: 7)
   1 MFNNCEVVLG NLEITYVQRN YDLSFLKTIQ EVAGYVLIAL NTVERIPLEN LQIIRGNMYY

61 ENSYALAVLS NYDANKTGLK ELPMRNLQEI LHGAVRFSNN PALCNVESIQ WRDIVSSDFL

121 SNMSMDFQNH LGSCQKCDPS CPNGSCWGAG EENCQKLTKI ICAQQCSGRC RGKSPSDCCH

181 NQCAAGCTGP RESDCLVCRK FRDEATCKDT CPPLMLYNPT TYQMDVNPEG KYSFGATCVK

241 KCPRNYVVTD HGSCVRACGA DSYEMEEDGV RKCKKCEGPC RKVCNGIGIG EFKDSLSINA

301 TNIKHFKNCT SISGDLHILP VAFRGDSFTH TPPLDPQELD ILKTVKEITG FLLIQAWPEN

361 RTDLHAFENL EIIRGRTKQH GQFSLAVVSL NITSLGLRSL KEISDGDVII SGNKNLCYAN

421 TINWKKLFGT SGQKTKIISN RGENSCKATG QVCHALCSPE GCWGPEPRDC VSCRNVSRGR

481 ECVDKCNLLE GEPREFVENS ECIQCHPECL PQAMNITCTG RGPDNCIQCA HYIDGPHCVK

541 TCPAGVMGEN NTLVWKYADA GHVCHLCHPN CTYGCTGPGL EGCPTNGPKI PSIATGMVGA

601 LLLLLVVALG IGLFMRRRHI VRKRTLRRLL QERELVEPLT PSGEAPNQAL LRILKETEFK

661 KIKVLGSGAF GTVYKGLWIP EGEKVKIPVA IKELREATSP KANKEILDEA YVMASVDNPH

721 VCRLLGICLT STVQLITQLM PFGCLLDYVR EHKDNIGSQY LLNWCVQIAK GMNYLEDRRL

781 VHRDLAARNV LVKTPQHVKI TDFGLAKLLG AEEKEYHAEG GKVPIKWMAL ESILHRIYTH
```

```
 841 QSDVWSYGVT VWELMTFGSK PYDGIPASEI SSILEKGERL PQPPICTIDV YMIMVKCWMI

901 DADSRPKFRE LIIEFSKMAR DPQRYLVIQG DERMHLPSPT DSNFYRALMD EEDMDDVVDA

961 DEYLIPQQGF FSSPSTSRTP LLSSLSATSN NSTVACIDRN GLQSCPIKED SFLQRYSSDP

1021 TGALTEDSID DTFLPVPEYI NQSVPKRPAG SVQNPVYHNQ PLNPAPSRDP HYQDPHSTAV

1081 GNPEYLNTVQ PTCVNSTEDS PAHWAQKGSH QISLDNPDYQ QDFFPKEAKP NGIFKGSTAE

1141 NAEYLRVAPQ SSEFIGA.
```

EGFR isoform i is described in NCBI record number NP_001333870.1, the contents of which are incorporated by reference herein. In some embodiments, EGFR comprises an amino acid sequence of:

```
                                                            (SEQ ID NO: 8)
   1 MRPSGTAGAA LLALLAALCP ASRALEEKKG NYVVTDHGSC VRACGADSYE MEEDGVRKCK

61 KCEGPCRKVC NGIGIGEFKD SLSINATNIK HFKNCTSISG DLHILPVAFR GDSFTHTPPL

121 DPQELDILKT VKEITGFLLI QAWPENRTDL HAFENLEIIR GRTKQHGQFS LAVVSLNITS

181 LGLRSLKEIS DGDVIISGNK NLCYANTINW KKLFGTSGQK TKIISNRGEN SCKATGQVCH

241 ALCSPEGCWG PEPRDCVSCR NVSRGRECVD KCNLLEGEPR EFVENSECIQ CHPECLPQAM

301 NITCTGRGPD NCIQCAHYID GPHCVKTCPA GVMGENNTLV WKYADAGHVC HLCHPNCTYG

361 CTGPGLEGCP TNGPKIPSIA TGMVGALLLL LVVALGIGLF MRRRHIVRKR TLRRLLQERE

421 LVEPLTPSGE APNQALLRIL KETEFKKIKV LGSGAFGTVY KGLWIPEGEK VKIPVAIKEL

481 REATSPKANK EILDEAYVMA SVDNPHVCRL LGICLTSTVQ LITQLMPFGC LLDYVREHKD

541 NIGSQYLLNW CVQIAKGMNY LEDRRLVHRD LAARNVLVKT PQHVKITDFG LAKLLGAEEK

601 EYHAEGGKVP IKWMALESIL HRIYTHQSDV WSYGVTVWEL MTFGSKPYDG IPASEISSIL

661 EKGERLPQPP ICTIDVYMIM VKCWMIDADS RPKFRELIIE FSKMARDPQR YLVIQGDERM

721 HLPSPTDSNF YRALMDEEDM DDVVDADEYL IPQQGFFSSP STSRTPLLSS LSATSNNSTV

781 ACIDRNGLQS CPIKEDSFLQ RYSSDPTGAL TEDSIDDTFL PVPEYINQSV PKRPAGSVQN

841 PVYHNQPLNP APSRDPHYQD PHSTAVGNPE YLNTVQPTCV NSTFDSPAHW AQKGSHQISL

901 DNPDYQQDFF PKEAKPNGIF KGSTAENAEY LRVAPQSSEF IGA.
```

In some embodiments, the cancer cell-specific antigen is a peptide antigen derived from EGFR. In some embodiments, the peptide antigen is comprises a sequence having at least 80%, at least 85%, at least 90%, at least 95%, at least 96%, at least 97%, at least 98%, or at least 99% identity to a sequence or subsequence of any one of SEQ ID NOs: 1-8. In some embodiments, the peptide antigen comprises a sequence identical to a subsequence of any one of SEQ ID NOs: 1-8 or SEQ ID NOs: 918-919.

Extracellular Ligand Binding Domain

The disclosure provides a first receptor, comprising a first extracellular ligand binding domain specific to a target antigen. In some embodiments, the target antigen comprises a cancer cell-specific antigen.

In some embodiments, the cancer cell-specific antigen is EGFR or a EGFR-derived peptide antigen complexed with MHC-I, and the ligand binding domain of the first receptor recognizes and binds to the EGFR antigen. In some embodiments, the cancer cell-specific antigen is a clinically relevant mutant of EGFR. For example, a mutated variant of EGFR can be a substitution mutation (e.g. L858R in exon 21), a deletion mutation (e.g. EGFRvIII or deletions in exon 19 or exon 23), or amplifications mutations to the EGFR gene.

Any type of ligand binding domain that can regulate the activity of a receptor in a ligand dependent manner is envisaged as within the scope of the instant disclosure. In some embodiments, the ligand binding domain is an antigen binding domain. Exemplary antigen binding domains include, inter alia, scFv, SdAb, Vβ-only domains, and TCR antigen binding domains derived from the TCR α and β chain variable domains.

Any type of antigen binding domain is envisaged as within the scope of the instant disclosure.

For example, the first extracellular ligand binding domain may be part of a contiguous polypeptide chain including, for example, a Vβ-only domain, a single domain antibody fragment (sdAb) or heavy chain antibodies HCAb, a single chain antibody (scFv) derived from a murine, humanized or human antibodies (Harlow et al., 1999, In: Using Antibodies: A Laboratory Manual, Cold Spring Harbor Laboratory Press, N.Y.; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In some aspects, the first extracellular ligand binding domain comprises an antigen binding domain that comprises an antibody fragment. In further aspects, the first extracellular ligand binding domain comprises an antibody fragment that comprises a scFv or an sdAb.

The term "antibody," as used herein, refers to a protein, or polypeptide sequences derived from an immunoglobulin molecule, which specifically binds to an antigen. Antibodies can be intact immunoglobulins of polyclonal or monoclonal origin, or fragments thereof and can be derived from natural or from recombinant sources.

The terms "antibody fragment" or "antibody binding domain" refer to at least one portion of an antibody, or recombinant variants thereof, that contains the antigen binding domain, i.e., an antigenic determining variable region of an intact antibody, that is sufficient to confer recognition and specific binding of the antibody fragment to a target, such as an antigen and its defined epitope. Examples of antibody fragments include, but are not limited to, Fab, Fab', F(ab')2, and Fv fragments, single-chain (sc)Fv ("scFv") antibody fragments, linear antibodies, single domain antibodies (abbreviated "sdAb") (either VL or VH), camelid VHH domains, and multi-specific antibodies formed from antibody fragments.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived.

"Heavy chain variable region" or "VH" (or, in the case of single domain antibodies, e.g., nanobodies, "VHH") with regard to an antibody refers to the fragment of the heavy chain that contains three CDRs interposed between flanking stretches known as framework regions, these framework regions are generally more highly conserved than the CDRs and form a scaffold to support the CDRs.

Unless specified, as used herein a scFv may have the VL and VH variable regions in either order, e.g., with respect to the N-terminal and C-terminal ends of the polypeptide, the scFv may comprise VL-linker-VH or may comprise VH-linker-VL.

In some embodiments, the antigen binding domain of the activator and/or inhibitory receptor comprises an scFv. In some embodiments, the scFv comprises a VL and VH region joined by a linker. In some embodiments, the linker comprises a glycine serine linker, for example GGGGSGGGGSGGGGSGG (SEQ ID NO: 136). In some embodiments, the scFv further comprises a signal sequence at the N terminus of the scFv. Exemplary signal sequences include MDMRVPAQLLGLLLLWLRGARC (SEQ ID NO: 137), which is encoded by ATGGACAT-GAGGGTCCCCGCTCAGCTCCTGGGGCTCCTGC-TACTCTGGCTCCGAGGT GCCAGATGT (SEQ ID NO: 138) or ATGGATAT-GAGAGTGCCTGCCCAGCTGCTCGGACTGCTCC-TTCTGTGGTTGAGAGGA GCTCGGTGC (SEQ ID NO: 917).

The term "antibody light chain," refers to the smaller of the two types of polypeptide chains present in antibody molecules in their naturally occurring conformations. Kappa ("κ") and lambda ("λ") light chains refer to the two major antibody light chain isotypes.

The term "recombinant antibody" refers to an antibody that is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "Vβ domain", "Vβ-only domain", "β chain variable domain" or "single variable domain TCR (svd-TCR)" refers to an antigen binding domain that consists essentially of a single T Cell Receptor (TCR) beta variable domain that specifically binds to an antigen in the absence of a second TCR variable domain. The Vβ-only domain engages antigen using complementarity-determining regions (CDRs). Each Vβ-only domain contains three complement determining regions (CDR1, CDR2, and CDR3). Additional elements may be combined provided that the Vβ domain is configured to bind the epitope in the absence of a second TCR variable domain.

In some embodiments, the extracellular ligand binding domain of the first receptor comprises an antibody fragment, a single chain Fv antibody fragment (scFv), or a β chain variable domain (Vβ).

In some embodiments, the extracellular ligand binding domain of the first receptor comprises a TCR α chain variable domain and a TCR β chain variable domain.

In some embodiments, the extracellular ligand binding domain of the first receptor comprises an scFv antigen binding domain. Exemplary EGFR scFv are shown in Table 1 below.

TABLE 1

| EGFR scFv domains | |
|---|---|
| Amino Acid Sequence | DNA Sequence |
| CT-478 EGFR<br>(VH-VL scFv Format):<br>QVQLVESGGGVVQPGRSLRLSC<br>AASGFTFSTYGMHWVRQAPG<br>KGLEWVAVIWDDGSYKYYGDS<br>VKGRFTISRDNSKNTLYLQMNS<br>LRAEDTAVYYCARDGITMVRGV<br>MKDYFDYWGQGTLVTVSSGG<br>GGSGGGGSGGGGSGGAIQLTQ<br>SPSSLSASVGDRVTITCRASQDIS<br>SALVWYQQKPGKAPKLLIYDAS<br>SLESGVPSRFSGSESGTDFTLTIS | CT-478 EGFR:<br>CAGGTGCAGCTGGTGGAGTCTGGGGGAGGCGTGGTCCAGCCTGGGAGGT<br>CCCTGAGACTCTCCTGTGCAGCGTCTGGATTCACCTTCAGTACCTATGGCA<br>TGCACTGGGTCCGCCAGGCTCCAGGCAAGGGGCTGGAGTGGGTGGCAGT<br>TATATGGGATGATGGAAGTTATAAATACTATGGAGACTCCGTGAAGGGCC<br>GATTCACCATCTCCAGAGACAATTCCAAGAACACGCTGTATCTGCAAATGA<br>ACAGCCTGAGAGCCGAGGACACGGCTGTGTATTACTGTGCGAGAGATGG<br>TATTACTATGGTTCGGGGAGTTATGAAGGACTACTTTGACTACTGGGGCC<br>AGGGAACCCTGGTCACCGTCTCCTCAGGCGGAGGTGGAAGCGGAGGGGG<br>AGGATCTGGCGGCGGAGGAAGCGGAGGCGCCATCCAGTTGACCCAGTCT<br>CCATCCTCCCTGTCTGCATCTGTAGGAGACAGAGTCACCATCACTTGCCGG<br>GCAAGTCAGGACATTAGCAGTGCTTTAGTCTGGTATCAGCAGAAACCAGG |

TABLE 1-continued

| EGFR scFv domains | |
|---|---|
| Amino Acid Sequence | DNA Sequence |
| SLQPEDFATYYCQQFNSYPLTF<br>GGGTKVEIK (SEQ ID NO: 9) | GAAAGCTCCTAAGCTCCTGATCTATGATGCCTCCAGTTTGGAAAGTGGGG<br>TCCCATCAAGGTTCAGCGGCAGTGAATCTGGGACAGATTTCACTCTCACCA<br>TCAGCAGCCTGCAGCCTGAAGATTTTGCAACTTATTACTGTCAACAGTTTA<br>ATAGTTACCCGCTCACTTTCGGCGGAGGGACCAAGGTGGAGATCAAA<br>(SEQ ID NO: 139) |
| CT-479 EGFR<br>(VL-HV scFv Format):<br>AIQLTQSPSSLSASVGDRVTITC<br>RASQDISSALVWYQQKPGKAP<br>KLLIYDASSLESGVPSRFSGSESG<br>TDFTLTISSLQPEDFATYYCQQF<br>NSYPLTFGGGTKVEIKGGGGSG<br>GGGSGGGGSGGQVQLVESGG<br>GVVQPGRSLRLSCAASGFTFSTY<br>GMHWVRQAPGKGLEWVAVI<br>WDDGSYKYYGDSVKGRFTISRD<br>NSKNTLYLQMNSLRAEDTAVYY<br>CARDGITMVRGVMKDYFDYW<br>GQGTLVTVSS (SEQ ID NO: 10) | CT-479 EGFR:<br>GCCATCCAGTTGACCCAGTCTCCATCCTCCCTGTCTGCATCTGTAGGAGAC<br>AGAGTCACCATCACTTGCCGGGCAAGTCAGGACATTAGCAGTGCTTTAGT<br>CTGGTATCAGCAGAAACCAGGGAAAGCTCCTAAGCTCCTGATCTATGATG<br>CCTCCAGTTTGGAAAGTGGGGTCCCATCAAGGTTCAGCGGCAGTGAATCT<br>GGGACAGATTTCACTCTCACCATCAGCAGCCTGCAGCCTGAAGATTTTGCA<br>ACTTATTACTGTCAACAGTTTAATAGTTACCCGCTCACTTTCGGCGGAGGG<br>ACCAAGGTGGAGATCAAAGGCGGAGGTGGAAGCGGAGGGGGAGGATCT<br>GGCGGCGGAGGAAGCGGAGGCCAGGTGCAGCTGGTGGAGTCTGGGGGA<br>GGCGTGGTCCAGCCTGGGAGGTCCCTGAGACTCTCCTGTGCAGCGTCTGG<br>ATTCACCTTCAGTACCTATGGCATGCACTGGGTCCGCCAGGCTCCAGGCAA<br>GGGGCTGGAGTGGGTGGCAGTTATATGGGATGATGGAAGTTATAAATAC<br>TATGGAGACTCCGTGAAGGGCCGATTCACCATCTCCAGAGACAATTCCAA<br>GAACACGCTGTATCTGCAAATGAACAGCCTGAGAGCCGAGGACACGGCT<br>GTGTATTACTGTGCGAGAGATGGTATTACTATGGTTCGGGGAGTTATGAA<br>GGACTACTTTGACTACTGGGGCCAGGGAACCCTGGTCACCGTCTCCTCA<br>(SEQ ID NO: 140) |
| CT-480 EGFR<br>(VH-VL scFv format):<br>QIQLVQSGPELKKPGETVKISCK<br>ASGYTFTEYPIHWVKQAPGKGF<br>KWMGMIYTDIGKPTYAEEFKG<br>RFAFSLETSASTAYLQINNLKNE<br>DTATYFCVRDRYDSLFDYWGQ<br>GTTLTVSSGGGGSGGGGSGGG<br>GSGGDVVMTQTPLSLPVSLGD<br>QASISCRSSQSLVHSNGNTYLH<br>WYLQKPGQSPKLLIYKVSNRFS<br>GVPDRFSGSGSGTDFTLKISRVE<br>AEDLGVYFCSQSTHVPWTFGG<br>GTKLEIK (SEQ ID NO: 11) | CT-480 EGFR:<br>CAGATCCAGTTGGTGCAGTCTGGACCTGAGCTGAAGAAGCCTGGAGAGA<br>CAGTCAAGATCTCCTGCAAGGCCTCTGGGTATACCTTCACAGAATATCCAA<br>TACACTGGGTGAAGCAGGCTCCAGGAAAGGGTTTCAAGTGGATGGGCAT<br>GATATACACCGACATTGGAAAGCCAACATATGCTGAAGAGTTCAAGGGAC<br>GGTTTGCCTTCTCTTTGGAGACCTCTGCCAGCACTGCCTATTTGCAGATCAA<br>CAACCTCAAGAATGAGGACACGGCTACATATTTCTGTGTAAGAGATCGAT<br>ATGATTCCCTCTTTGACTACTGGGGCCAAGGCACCACTCTCACAGTCTCCTC<br>AGGCGGAGGTGGAAGCGGAGGGGGAGGATCTGGCGGCGGAGGAAGCG<br>GAGGCGATGTTGTGATGACCCAAACTCCACTCTCCCTGCCTGCTGCCAGTCTTG<br>GAGATCAAGCCTCCATCTCTTGCAGATCTAGTCAGAGCCTTGTACACAGTA<br>ATGGAAACACCTATTTACATTGGTACCTGCAGAAGCCAGGCCAGTCTCCAA<br>AGCTCCTGATCTACAAAGTTTCCAACCGATTTTCTGGGGTCCCAGACAGGT<br>TCAGTGGCAGTGGATCAGGGACAGATTTCACACTCAAGATCAGCAGAGTG<br>GAGGCTGAGGATCTGGGAGTTTATTTCTGCTCTCAAAGTACACATGTTCCG<br>TGGACGTTCGGTGGAGGCACCAAGCTGGAAATCAAA (SEQ ID NO: 141) |
| CT-481 EGFR<br>(VL-VH scFv Format):<br>DVVMTQTPLSLPVSLGDQASIS<br>CRSSQSLVHSNGNTYLHWYLQ<br>KPGQSPKLLIYKVSNRFSGVPDR<br>FSGSGSGTDFTLKISRVEAEDLG<br>VYFCSQSTHVPWTFGGGTKLEI<br>KGGGGSGGGGSGGGGSGGQI<br>QLVQSGPELKKPGETVKISCKAS<br>GYTFTEYPIHWVKQAPGKGFK<br>WMGMIYTDIGKPTYAEEFKGR<br>FAFSLETSASTAYLQINNLKNED<br>TATYFCVRDRYDSLFDYWGQG<br>TTLTVSS (SEQ ID NO: 12) | CT-481 EGFR:<br>GATGTTGTGATGACCCAAACTCCACTCTCCCTGCCTGTCAGTCTTGGAGAT<br>CAAGCCTCCATCTCTTGCAGATCTAGTCAGAGCCTTGTACACAGTAATGGA<br>AACACCTATTTACATTGGTACCTGCAGAAGCCAGGCCAGTCTCCAAAGCTC<br>CTGATCTACAAAGTTTCCAACCGATTTTCTGGGGTCCCAGACAGGTTCAGT<br>GGCAGTGGATCAGGGACAGATTTCACACTCAAGATCAGCAGAGTGGAGG<br>CTGAGGATCTGGGAGTTTATTTCTGCTCTCAAAGTACACATGTTCCGTGGA<br>CGTTCGGTGGAGGCACCAAGCTGGAAATCAAAGGCGGAGGTGGAAGCG<br>GAGGGGGAGGATCTGGCGGCGGAGGAAGCGGAGGCCAGATCCAGTTGG<br>TGCAGTCTGGACCTGAGCTGAAGAAGCCTGGAGAGACAGTCAAGATCTCC<br>TGCAAGGCCTCTGGGTATACCTTCACAGAATATCCAATACACTGGGTGAA<br>GCAGGCTCCAGGAAAGGGTTTCAAGTGGATGGGCATGATATACACCGAC<br>ATTGGAAAGCCAACATATGCTGAAGAGTTCAAGGGACGGTTTGCCTTCTC<br>TTTGGAGACCTCTGCCAGCACTGCCTATTTGCAGATCAACAACCTCAAGAA<br>TGAGGACACGGCTACATATTTCTGTGTAAGAGATCGATATGATTCCCTCTT<br>TGACTACTGGGGCCAAGGCACCACTCTCACAGTCTCCTCA<br>(SEQ ID NO: 142) |
| CT-482 EGFR<br>(VH-VL scFv Format):<br>EMQLVESGGGFVKPGGSLKLSC<br>AASGFAFSHYDMSWVRQTPK<br>QRLEWVAYIASGGDITYYADTV<br>KGRFTISRDNAQNTLYLQMSSL<br>KSEDTAMFYCSRSSYGNNGDAL<br>DFWGQGTSVTVSSGGGGSGG<br>GGSGGGGSGGDVVMTQTPLSL<br>PVSLGDQASISCRSSQSLVHSN<br>GNTYLHWYLQKPGQSPKLLIYK<br>VSNRFSGVPDRFSGSGSGTDFT<br>LKISRVEAEDLGVYFCSQSTHVL<br>TFGSGTKLEIK (SEQ ID NO: 13) | CT-482 EGFR:<br>GAAATGCAGCTGGTGGAGTCTGGGGGAGGCTTCGTGAAGCCTGGAGGGT<br>CCCTGAAACTCTCATGTGCAGCCTCTGGATTCGCTTTCAGTCACTATGACAT<br>GTCTTGGGTTCGCCAGACTCCAAAGCAGAGGCTGGAGTGGGTCGCATACA<br>TTGCTAGTGGTGGTGATATCACCTACTATGCAGACACTGTGAAGGGCCGA<br>TTCACCATCTCCAGAGACAATGCCCAGAACACCCTGTACCTGCAAATGAGC<br>AGTCTGAAGTCTGAGGACACAGCCATGTTTTACTGTTCACGATCCTCCTAT<br>GGTAACAACGGAGATGCCCTGGACTTCTGGGGTCAAGGTACCTCAGTCAC<br>CGTCTCCTCAGGCGGAGGTGGAAGCGGAGGGGGAGGATCTGGCGGCGG<br>AGGAAGCGGAGGCGATGTTGTGATGACCCAAACTCCACTCTCCCTGCCTG<br>TCAGTCTTGGAGATCAAGCCTCCATCTCTTGCAGATCTAGTCAGAGCCTTG<br>TTCACAGTAATGGAAACACCTATTTACATTGGTACCTGCAGAAGCCAGGCC<br>AGTCTCCAAAGCTCCTGATCTACAAAGTTTCCAACCGATTTTCTGGGGTCC<br>CAGACAGGTTCAGTGGCAGTGGATCAGGGACAGATTTCACACTCAAGATC<br>AGCAGAGTGGAGGCTGAGGATCTGGGAGTTTATTTCTGCTCTCAAAGTAC<br>ACATGTTCTCACGTTCGGCTCGGGGACAAAGTTGGAAATAAAA<br>(SEQ ID NO: 143) |

TABLE 1-continued

EGFR scFv domains

| Amino Acid Sequence | DNA Sequence |
|---|---|
| CT-483 EGFR<br>(VL-VH scFv Format):<br>DVVMTQTPLSLPVSLGDQASIS<br>CRSSQSLVHSNGNTYLHWYLQ<br>KPGQSPKLLIYKVSNRFSGVPDR<br>FSGSGSGTDFTLKISRVEAEDLG<br>VYFCSQSTHVLTFGSGTKLEIKG<br>GGGSGGGGSGGGGSGGEMQL<br>VESGGGFVKPGGSLKLSCAASG<br>FAFSHYDMSWVRQTPKQRLE<br>WVAYIASGGDITYYADTVKGRF<br>TISRDNAQNTLYLQMSSLKSED<br>TAMFYCSRSSYGNNGDALDFW<br>GQGTSVTVSS (SEQ ID NO: 14) | CT-483 EGFR:<br>GATGTTGTGATGACCCAAACTCCACTCTCCCTGCCTGTCAGTCTTGGAGAT<br>CAAGCCTCCATCTCTGCCAGATCTAGTCAGAGCCTTGTTCACAGTAATGGA<br>AACACCTATTTACATTGGTACCTGCAGAAGCCAGGCCAGTCTCCAAAGCTC<br>CTGATCTACAAAGTTTCCAACCGATTTTCTGGGGTCCCAGACAGGTTCAGT<br>GGCAGTGGATCAGGGACAGATTTCACACTCAAGATCAGCAGAGTGGAGG<br>CTGAGGATCTGGGAGTTTATTTCTGCTCTCAAAGTACACATGTTCTCACGTT<br>CGGCTCGGGGACAAAGTTGGAAATAAAAGGCGGAGGTGGAAGCGGAGG<br>GGGAGGATCTGGCGGCGGAGGAAGCGGAGGCGAAATGCAGCTGGTGGA<br>GTCTGGGGGAGGCTTCGTGAAGCCTGGAGGGTCCCTGAAACTCTCATGTG<br>CAGCCTCTGGATTCGCTTTCAGTCACTATGACATGTCTTGGGTTCGCCAGA<br>CTCCGAAGCAGAGGCTGGAGTGGGTCGCATACATTGCTAGTGGTGGTGAT<br>ATCACCTACTATGCAGACACTGTGAAGGGCCGATTCACCATCTCCAGAGAC<br>AATGCCCAGAACACCCTGTACCTGCAAATGAGCAGTCTGAAGTCTGAGGA<br>CACAGCCATGTTTTACTGTTCACGATCCTCCTATGGTAACAACGGAGATGC<br>CCTGGACTTCTGGGGTCAAGGTACCTCAGTCACCGTCTCCTCA<br>(SEQ ID NO: 144) |
| CT-486 EGFR<br>(VH-VL scFv Format):<br>QVQLKQSGPGLVQPSQSLSITC<br>TVSGFSLTNYGVHWVRQSPGK<br>GLEWLGVIWSGGNTDYNTPFT<br>SRLSINKDNSKSQVFFKMNSLQ<br>SNDTAIYYCARALTYYDYEFAY<br>WGQGTLVTVSAGGGGSGGGG<br>SGGGGSGGDILLTQSPVILSVSP<br>GERVSFSCRASQSIGTNIHWYQ<br>QRTNGSPRLLIKYASESISGIPSR<br>FSGSGSGTDFTLSINSVESEDIAD<br>YYCQQNNNWPTTFGAGTKLELK<br>(SEQ ID NO: 15) | CT-486 EGFR:<br>CAGGTGCAGCTGAAGCAGTCCGGCCCCGGCCTGGTGCAGCCCTCCCAGTC<br>CCTGTCCATCACCTGCACCGTGTCCGGCTTCTCCCTGACCAACTACGGCGT<br>GCACTGGGTGCGGCAGTCCCCCGGCAAGGGCCTGGAGTGGCTGGGCGTG<br>ATCTGGTCCGGCGGCAACACCGACTACAACACCCCCTTCACCTCCCGGCTG<br>TCCATCAACAAGGACAACTCCAAGTCCCAGGTGTTCTTCAAGATGAACTCC<br>CTGCAGTCCAACGACACCGCCATCTACTACTGCGCCCGGGCCCTGACCTAC<br>TACGACTACGAGTTCGCCTACTGGGGCCAGGGCACCCTGGTGACCGTGTC<br>CGCCGGCGGAGGTGGAAGCGGAGGGGGAGGATCTGGCGGCGGAGGAA<br>GCGGAGGCGACATCCTGCTGACCCAGTCCCCCGTGATCCTGTCCGTGTCCC<br>CCGGCGAGCGGGTGTCCTTCTCCTGCCGGGCCTCCCAGTCCATCGGCACC<br>AACATCCACTGGTACCAGCAGCGGACCAACGGCTCCCCCCGGCTGCTGAT<br>CAAGTACGCCTCCGAGTCCATCTCCGGCATCCCCTCCCGGTTCTCCGGCTC<br>CGGCTCCGGCACCGACTTCACCCTGTCCATCAACTCCGTGGAGTCCGAGG<br>ACATCGCCGACTACTACTGCCAGCAGAACAACAACTGGCCCACCACCTTCG<br>GCGCCGGCACCAAGCTGGAGCTGAAG (SEQ ID NO: 145) |
| CT-487 EGFR<br>(VH-VL scFv Format):<br>QVQLVQSGAEVKKPGASVKVS<br>CKASGYTFTSHWMHWVRQAP<br>GQGLEWIGEFNPSNGRTNYNE<br>KFKSKATMTVDTSTNTAYMELS<br>SLRSEDTAVYYCASRDYDYDGR<br>YFDYWGQGTLVTVSSGGGGSG<br>GGGSGGGGSGGDIQMTQSPSS<br>LSASVGDRVTITCSASSSVTYMY<br>WYQQKPGKAPKLLIYDTSNLAS<br>GVPSRFSGSGSGTDYTFTISSLQ<br>PEDIATYYCQQWSSHIFTFGQG<br>TKVEIK (SEQ ID NO: 16) | CT-487 EGFR:<br>CAGGTGCAGCTGGTGCAGTCCGGCGCCGAGGTGAAGAAGCCCGGCGCCT<br>CCGTGAAGGTGTCCTGCAAGGCCTCCGGCTACACCTTCACCTCCCACTGGA<br>TGCACTGGGTGCGGCAGGCCCCCGGCCAGGGCCTGGAGTGGATCGGCGA<br>GTTCAACCCCTCCAACGGCCGGACCAACTACAACGAGAAGTTCAAGTCCA<br>AGGCCACCATGACCGTGGACACCTCCACCAACACCGCCTACATGGAGCTG<br>TCCTCCCTGCGGTCCGAGGACACCGCCGTGTACTACTGCGCCTCCCGGGAC<br>TACGACTACGACGGCCGGTACTTCGACTACTGGGGCCAGGGCACCCTGGT<br>GACCGTGTCCTCCGGCGGAGGTGGAAGCGGAGGGGGAGGATCTGGCGG<br>CGGAGGAAGCGGAGGCGACATCCAGATGACCCAGTCCCCCTCCTCCCTGT<br>CCGCCTCCGTGGGCGACCGGGTGACCATCACCTGCTCCGCCTCCTCCTCCG<br>TGACCTACATGTACTGGTACCAGCAGAAGCCCGGCAAGGCCCCCAAGCTG<br>CTGATCTACGACACCTCCAACCTGGCCTCCGGCGTGCCCTCCCGGTTCTCC<br>GGCTCCGGCTCCGGCACCGACTACACCTTCACCATCTCCTCCCTGCAGCCC<br>GAGGACATCGCCACCTACTACTGCCAGCAGTGGTCCTCCCACATCTTCACC<br>TTCGGCCAGGGCACCAAGGTGGAGATCAAG (SEQ ID NO: 146) |
| CT-488 EGFR<br>(VH-VL scFv Format):<br>QVQLQESGPGLVKPSETLSLTCT<br>VSGGSVSSGDYYWTWIRQSPG<br>KGLEWIGHIYYSGNTNYNPSLKS<br>RLTISIDTSKTQFSLKLSSVTAAD<br>TAIYYCVRDRVTGAFDIWGQGT<br>MVTVSSGGGGSGGGGSGGGG<br>SGGDIQMTQSPSSLSASVGDRV<br>TITCQASQDISNYLNWYQQKPG<br>KAPKLLIYDASNLETGVPSRFSG<br>SGSGTDFTFTISSLQPEDIATYFC<br>QHFDHLPLAFGGGTKVEIK<br>(SEQ ID NO: 17) | CT-488 EGFR:<br>CAGGTGCAGCTGCAGGAGTCCGGCCCCGGCCTGGTGAAGCCCTCCGAGA<br>CCCTGTCCCTGACCTGCACCGTGTCCGGCGGCTCCGTGTCCTCCGGCGACT<br>ACTACTGGACCTGGATCCGGCAGTCCCCCGGCAAGGGCCTGGAGTGGATC<br>GGCCACATCTACTACTCCGGCAACACCAACTACAACCCCTCCCTGAAGTCC<br>CGGCTGACCATCTCCATCGACACCTCCAAGACCCAGTTCTCCCTGAAGCTG<br>TCCTCCGTGACCGCCGCCGACACCGCCATCTACTACTGCGTGCGGGACCG<br>GGTGACCGGCGCCTTCGACATCTGGGGCCAGGGCACCATGGTGACCGTGT<br>CCTCCGGCGGAGGTGGAAGCGGAGGGGGAGGATCTGGCGGCGGAGGAA<br>GCGGAGGCGACATCCAGATGACCCAGTCCCCCTCCTCCCTGTCCGCCTCCG<br>TGGGCGACCGGGTGACCATCACCTGCCAGGCCTCCCAGGACATCTCCAAC<br>TACCTGAACTGGTACCAGCAGAAGCCCGGCAAGGCCCCCAAGCTGCTGAT<br>CTACGACGCCTCCAACCTGGAGACCGGCGTGCCCTCCCGGTTCTCCGGCTC<br>CGGCTCCGGCACCGACTTCACCTTCACCATCTCCTCCCTGCAGCCCGAGGA<br>CATCGCCACCTACTTCTGCCAGCACTTCGACCACCTGCCCCTGGCCTTCGGC<br>GGCGGCACCAAGGTGGAGATCAAG (SEQ ID NO: 147) |
| CT-489 EGFR scFv:<br>QVQLQESGPGLVKPSQTLSLTC<br>TVSGGSISSGDYYWSWIRQPPG<br>KGLEWIGYIYYSGSTDYNPSLKS<br>RVTMSVDTSKNQFSLKVNSVTA<br>ADTAVYYCARVSIFGVGTFDYW | CAGGTCCAGCTCCAAGAGTCAGGACCAGGTCTGGTCAAACCCTCACAGAC<br>GCTCTCTCTTACTTGCACAGTATCAGGCGGATCCATTAGTTCCGGTGATTAT<br>TACTGGTCTTGGATCCGCCAGCCTCCTGGTAAGGGGCTGGAGTGGATCGG<br>ATACATATACTACAGTGGTTCCACTGATTATAATCCGTCACTCAAGTCCCGA<br>GTAACTATGTCCGTGGATACTAGCAAAAATCAGTTCAGCCTCAAAGTCAAT<br>TCCGTAACTGCCGCCGACACCGCGGTCTATTATTGTGCGCGGGTGAGCAT |

TABLE 1-continued

EGFR scFv domains

| Amino Acid Sequence | DNA Sequence |
|---|---|
| GQGTLVTVSSGGGGSGGGGSG<br>GGGSGGEIVMTQSPATLSLSPG<br>ERATLSCRASQSVSSYLAWYQQ<br>KPGQAPRLLIYDASNRATGIPAR<br>FSGSGSGTDFTLTISSLEPEDFAV<br>YYCHQYGSTPLTFGGGTKAEIK<br>(SEQ ID NO:18) | CTTCGGCGTCGGTACGTTCGATTACTGGGGACAAGGAACTCTCGTAACAG<br>TAAGCTCTGGCGGAGGTGGAAGCGGAGGGGGAGGATCTGGCGGCGGAG<br>GAAGCGGAGGCGAGATTGTAATGACCCAAAGCCCTGCCACTCTTTCTCTG<br>TCTCCGGGGGAACGAGCGACTCTGTCATGTAGGGCGTCCCAGAGTGTCTC<br>TAGCTACCTCGCATGGTATCAGCAGAAACCCGGACAAGCCCCTCGGCTCTT<br>GATTTACGATGCCTCAAACAGAGCAACGGGGATTCCGGCACGGTTCAGCG<br>GGTCTGGTAGCGGGACAGACTTCACACTGACGATCTCTTCACTCGAACCA<br>GAAGATTTTGCAGTCTACTATTGCCATCAGTATGGTTCTACGCCACTTACAT<br>TTGGCGGGGGCACCAAGGCGGAGATAAAA (SEQ ID NO: 148) |

In some embodiments, the activator ligand is EGFR or a peptide antigen thereof, and the activator ligand binding domain comprises an EGFR binding domain. In some embodiments, the EGFR ligand binding domain comprises an scFv domain. In some embodiments, the EGFR ligand binding domain comprises a sequence of any one of SEQ ID NOs: 9-18. In some embodiments, the EGFR ligand binding domain comprises a sequence at least 90%, at least 95% or at least 99% identical to any one of SEQ ID NOs: 9-18. In some embodiments, the EGFR ligand binding domain is encoded by a sequence selected from the group of sequences in Table 1. In some embodiments, the EGFR ligand binding domain is encoded by a sequence having at least 80% identity, at least 85% identity, at least 90% identity, at least 95% identity or at least 99% identity to a sequence from Table 1. It is understood that the scFv domains of the disclosure that bind EGFR can cross-react with one or more variants of EGFR. For example, an scFv may bind at least one of a normal EGFR, a variant of EGFR, or a mutated EGFR (e.g. EGFRvIII).

In some embodiments, the extracellular ligand binding domain of the first receptor comprises an scFv antigen binding domain having at least 80% identity, at least 85% identity, at least 90% identity, at least 95% identity, at least 97% identity or at least 99% identity to any one of SEQ ID NOs: 9-18. In some embodiments, the extracellular ligand binding domain of the first receptor comprises an ScFv antigen binding domain comprising a sequence of any one of SEQ ID NOs: 9-18. In some embodiments, the extracellular ligand binding domain of the first receptor consists essentially of a sequence selected from the group consisting of SEQ ID NOs: 9-18.

TABLE 2

EGFR Variable Heavy (VH) and Variable Light (VL) domains

| EGFR VH | EGFR VL |
|---|---|
| CT478, CT479:<br>QVQLVESGGGVVQPGRSLRLSCAASGFTFSTYGMHWVR<br>QAPGKGLEWVAVIWDDGSYKYYGDSVKGRFTISRDNSKN<br>TLYLQMNSLRAEDTAVYYCARDGITMVRGVMKDYFDYW<br>GQGTLVTVSS (SEQ ID NO: 19) | CT478, CT479:<br>AIQLTQSPSSLSASVGDRVTITCRASQDISSALVWY<br>QQKPGKAPKLLIYDASSLESGVPSRFSGSESGTDFT<br>LTISSLQPEDFATYYCQQFNSYPLTFGGGTKVEIK<br>(SEQ ID NO: 25) |
| CT480, CT481:<br>QIQLVQSGPELKKPGETVKISCKASGYTFTEYPIHWVKQA<br>PGKGFKWMGMIYTDIGKPTYAEEFKGRFAFSLETSASTAY<br>LQINNLKNEDTATYFCVRDRYDSLFDYWGQGTTLTVSS<br>(SEQ ID NO: 20) | CT480, CT481:<br>DVVMTQTPLSLPVSLGDQASISCRSSQSLVHSNG<br>NTYLHWYLQKPGQSPKLLIYKVSNRFSGVPDRFSG<br>SGSGTDFTLKISRVEAEDLGVYFCSQSTHVPWTFG<br>GGTKLEIK (SEQ ID NO: 26) |
| CT482, CT483:<br>EMQLVESGGGFVKPGGSLKLSCAASGFAFSHYDMSWVRQT<br>PKQRLEWVAYIASGGDITYYADTVKGRFTISRDNAQNTLY<br>LQMSSLKSEDTAMFYCSRSSYGNNGDALDFWGQGTSVTV<br>SS (SEQ ID NO: 21) | CT482, CT483:<br>DVVMTQTPLSLPVSLGDQASISCRSSQSLVHSNG<br>NTYLHWYLQKPGQSPKLLIYKVSNRFSGVPDRFSG<br>SGSGTDFTLKISRVEAEDLGVYFCSQSTHVLTFGS<br>GTKLEIK (SEQ ID NO: 27) |
| CT486:<br>QVQLKQSGPGLVQPSQSLSITCTVSGFSLTNYGVHWVRQS<br>PGKGLEWLGVIWSGGNTDYNTPFTSRLSINKDNSKSQVFF<br>KMNSLQSNDTAIYYCARALTYYDYEFAYWGQGTLVTVSA<br>(SEQ ID NO: 22) | CT486:<br>DILLTQSPVILSVSPGERVSFSCRASQSIGTNIHWY<br>QQRTNGSPRLLIKYASESISGIPSRFSGSGSGTDFT<br>LSINSVESEDIADYYCQQNNNWPTTFGAGTKLELK<br>(SEQ ID NO: 28) |
| CT487:<br>QVQLVQSGAEVKKPGASVKVSCKASGYTFTSHWMHWVR<br>QAPGQGLEWIGEFNPSNGRTNYNEKFKSKATMTVDTSTN<br>TAYMELSSLRSEDTAVYYCASRDYDYDGRYFDYWGQGTLV<br>TVSS (SEQ ID NO: 23) | CT487:<br>DIQMTQSPSSLSASVGDRVTITCSASSSVTYMYWYQ<br>QKPGKAPKLLIYDTSNLASGVPSRFSGSGSGTDYTF<br>TISSLQPEDIATYYCQQWSSHIFTFGQGTKVEIK<br>(SEQ ID NO: 29) |
| CT488:<br>QVQLQESGPGLVKPSETLSLTCTVSGGSVSSGDYYWTWIR<br>QSPGKGLEWIGHIYYSGNTNYNPSLKSRLTISIDTSKTQF<br>SLKLSSVTAADTAIYYCVRDRVTGAFDIWGQGTMVTVSS<br>(SEQ ID NO: 24) | CT488:<br>DIQMTQSPSSLSASVGDRVTITCQASQDISNYLN<br>WYQQKPGKAPKLLIYDASNLETGVPSRFSGSGSG<br>TDFTFTISSLQPEDIATYFCQHFDHLPLAFGGGT<br>KVEIK (SEQ ID NO: 30) |

TABLE 2-continued

EGFR Variable Heavy (VH) and Variable Light (VL) domains

| EGFR VH | EGFR VL |
|---|---|
| CT489:<br>QVQLQESGPGLVKPSQTLSLTCTVSGGSISSGDYYWSWIR<br>QPPGKGLEWIGYIYYSGSTDYNPSLKSRVTMSVDTSKNQFS<br>LKVNSVTAADTAVYYCARVSIFGVGTFDYWGQGTLVTVSS<br>(SEQ ID NO: 149) | CT: 489:<br>EIVMTQSPATLSLSPGERATLSCRASQSVSSYLAW<br>YQQKPGQAPRLLIYDASNRATGIPARFSGSGSGT<br>DFTLTISSLEPEDFAVYYCHQYGSTPLTFGGGTKA<br>EIK (SEQ ID NO: 150) |

In some embodiments, the activator ligand is EGFR or a peptide antigen thereof, and the activator ligand binding domain comprises an EGFR ligand binding domain. In some embodiments, the EGFR binding domain comprises a VH and/or a VL domain selected from the group disclosed in Table 2 or a sequence having at least 90% identity, at least 9500 identity, at least 9700 identity or at least 9900 identity thereto. In some embodiments, the EGFR ligand binding domain comprises a VH-domain selected from the group consisting of SEQ TD NOs: 19-24. In some embodiments, the EGFR ligand binding domain comprises a VH selected from the group consisting of SEQ ID NOs: 19-24 or a sequence having at least 90%, at least 9500 or at least 9900 identity thereto. In some embodiments, the EGFR ligand binding domain comprises a VL domain selected from the group consisting of SEQ ID NOs: 25-30. In some embodiments, the EGFR ligand binding domain comprises a VL selected from the group consisting of SEQ TD NOs: 25-30 or a sequence having at least 90%, at least 9500 or at least 9900 identity thereto.

In some embodiments, the activator ligand is EGFR or a peptide antigen thereof, and the activator ligand binding domain is an EGFR ligand binding domain. In some embodiments, the EGFR binding domain comprises complementarity determining region (CDRs) selected from the group of CDRs disclosed in Table 3. In some embodiments, the EGFR ligand binding domain comprises CDRs having at least 9500 sequence identity to CDRs disclosed in Table 3. In some embodiments, the EGFR ligand binding domain comprises CDRs selected from SEQ TD NOs: 31-65. In some embodiments, the EGFR ligand binding domain comprises a heavy chain CDR 1 (CDR H1) selected from the group consisting of SEQ TD NOs: 31-36. In some embodiments, the EGFR ligand binding domain comprises a heavy chain CDR 2 (CDR H-2) selected from the group consisting of SEQ TD NOs: 37-42. In some embodiments, the EGFR ligand binding domain comprises a heavy chain CDR 3 (CDR H-3) selected from the group consisting of SEQ ID NOs: 43-48. In some embodiments, the EGFR ligand binding domain comprises a light chain CDR 1 (CDR L1) selected from the group consisting of SEQ ID NOs: 49-54.

TABLE 3

EGFR antigen binding domain CDRs.

| CDR H1 | CDR H2 | CDR H3 | CDR L1 | CDR L2 | CDR L3 |
|---|---|---|---|---|---|
| TYGMH (SEQ ID NO: 31) | VIWDDGSY KYYGDSVKG (SEQ ID NO: 37) | DGITMVRGV MKDYFDY (SEQ ID NO: 43) | RASQD ISSALV (SEQ ID NO: 49) | DASSLES (SEQ ID NO: 55) | QQFNSYPLT (SEQ ID NO: 60) |
| EYPIH (SEQ ID NO: 32) | MIYTDIGKPTYAE EFKG (SEQ ID NO: 38) | DRYDSLFDY (SEQ ID NO: 44) | RSSQSLVHSN GNTYLH (SEQ ID NO: 50) | KVSNRFS (SEQ ID NO: 56) | SQSTHVPW T (SEQ ID NO: 61) |
| HYDMS (SEQ ID NO: 33) | YIASGGDITYYAD TVKG (SEQ ID NO: 39) | SSYGNN GDALDF (SEQ ID NO: 45) | RSSQSLVHSN GNTYLH (SEQ ID NO: 51) | KVSNRFS (SEQ ID NO: 56) | SQSTHVLT (SEQ ID NO: 62) |
| NYGVH (SEQ ID NO: 34) | VIWSGGNTDYN TPFTS (SEQ ID NO: 40) | ALTYYDYEFAY (SEQ ID NO: 46) | RASQSIGTNIH (SEQ ID NO: 52) | YASESIS (SEQ ID NO: 57) | QQNNNWP TT (SEQ ID NO: 63) |
| SHWMH (SEQ ID NO: 35) | EFNPSNGRTN YNEKFKS (SEQ ID NO: 41) | RDYDYDGRY FDY (SEQ ID NO: 47) | SASSSVTYMY (SEQ ID NO: 53) | DTSNLAS (SEQ ID NO: 58) | QQWSSHIFT (SEQ ID NO: 64) |
| SGDYYWT (SEQ ID NO: 36) | HIYYSGNTNYNP SLKS (SEQ ID NO: 42) | DRVTGAFDI (SEQ ID NO: 48) | QASQDISNYLN (SEQ ID NO: 54) | DASNLET (SEQ ID NO: 59) | QHFDHLPLA (SEQ ID NO: 65) |
| SGDYYWS (SEQ ID NO: 151) | YIYYSGSTD YNPSLKS (SEQ ID NO: 152) | VSIFGVGTFDY (SEQ ID NO: 153) | RASQSVSSYLA (SEQ ID NO: 154) | DASNRAT (SEQ ID NO: 155) | HQYGSTPLT SEQ ID NO: 156) |

In some embodiments, the EGFR ligand binding domain comprises a light chain CDR 2 (CDR L2) selected from the group consisting of SEQ ID NOs: 55-59. In some embodiments, the EGFR ligand binding domain comprises a light chain CDR 3 (CDR L3) selected from the group consisting of SEQ ID NOs: 60-65. In some embodiments, the EGFR ligand binding domain comprises a CDR H1 selected from SEQ ID NOs: 31-36, a CDR H2 selected from SEQ ID NOs: 37-42, a CDR H3 selected from SEQ ID NOs: 43-48, a CDR L1 selected from SEQ ID NOs: 49-54, a CDR L2 selected from SEQ ID NOs: 55-59, and a CDR L3 selected from SEQ ID NOs: 60-65.

In some embodiments, one or more (e.g., 1, 2, 3, 4, 5, or 6) amino acid residues in a CDR of the antigen binding domains provided herein are substituted with another amino acid. The substitution may be "conservative" in the sense of being a substitution within the same family of amino acids. The naturally occurring amino acids may be divided into the following four families and conservative substitutions will take place within those families: (1) amino acids with basic side chains: lysine, arginine, histidine; (2) amino acids with acidic side chains: aspartic acid, glutamic acid; (3) amino acids with uncharged polar side chains: asparagine, glutamine, serine, threonine, tyrosine; and (4) amino acids with nonpolar side chains: glycine, alanine, valine, leucine, isoleucine, proline, phenylalanine, methionine, tryptophan, cysteine. By varying the amino acid sequence of the CDRs of an antibody by addition, deletion or substitution of amino acids, various effects such as increased binding affinity for the target antigen may be obtained.

Chimeric Antigen Receptors (CARs)

The disclosure provides a first, activator receptor and immune cells comprising same. In some embodiments, the first receptor is a chimeric antigen receptor.

In some embodiments, the first receptor comprises SEQ ID NO: 175, or a sequence sharing at least 75%, at least 80%, at least 85%, at least 90%, at least 95%, or at least 98% identity thereto. In some embodiments, the first receptor comprises SEQ ID NO: 176, or a sequence sharing at least 75%, at least 80%, at least 85%, at least 90%, at least 95%, or at least 98% identity thereto. In some embodiments, the first receptor comprises SEQ ID NO: 177, or a sequence sharing at least 75%, at least 80%, at least 85%, at least 90%, at least 95%, or at least 98% identity thereto.

The term "chimeric antigen receptors (CARs)" as used herein, may refer to artificial receptors derived from T-cell receptors and encompasses engineered receptors that graft an artificial specificity onto a particular immune effector cell. CARs may be employed to impart the specificity of a monoclonal antibody onto a T cell, thereby allowing a large number of specific T cells to be generated, for example, for use in adoptive cell therapy. In specific embodiments, CARs direct specificity of the cell to a tumor associated antigen, for example. Exemplary CARs comprise an intracellular activation domain, a transmembrane domain, and an extracellular domain comprising a tumor associated antigen binding region. In some embodiments, CARs further comprise a hinge domain. In particular aspects, CARs comprise fusions of single-chain variable fragments (scFv) derived from monoclonal antibodies, fused to a CD3 transmembrane domain and endodomain. The specificity of other CAR designs may be derived from ligands of receptors (e.g., peptides). In certain cases, CARs comprise domains for additional co-stimulatory signaling, such as CD3, 4-1BB, FcR, CD27, CD28, CD137, DAP10, and/or OX40. In some cases, molecules can be co-expressed with the CAR, including co-stimulatory molecules, reporter genes for imaging, gene products that conditionally ablate the T cells upon addition of a pro-drug, homing receptors, cytokines, and cytokine receptors.

In some embodiments, the extracellular ligand binding domain of the first receptor is fused to the extracellular domain of a CAR.

In some embodiments, the CARs of the present disclosure comprise an extracellular hinge region. Incorporation of a hinge region can affect cytokine production from CAR-T cells and improve expansion of CAR-T cells in vivo. Exemplary hinges can be isolated or derived from IgD and CD8 domains, for example IgG1. In some embodiments, the hinge is isolated or derived from CD8α or CD28.

In some embodiments, the hinge is isolated or derived from CD8α or CD28. In some embodiments, the CD8α hinge comprises an amino acid sequence having at least 80% identity, at least 90% identity, at least 95% identity, at least 99% identity or is identical to a sequence of TTTPAPRPPT-PAPTIASQPLSLRPEACRPAAGGAVHTRGLDFACD (SEQ ID NO: 66). In some embodiments, the CD8α hinge comprises SEQ ID NO: 66. In some embodiments, the CD8α hinge consists essentially of SEQ ID NO: 66. In some embodiments, the CD8α hinge is encoded by a nucleotide sequence having at least 80% identity, at least 90% identity, at least 95% identity, at least 99% identity or is identical to a sequence of ACCACGACGCCAGCGCCGCGACCAC-CAACACCGGCGCCCAC-CATCGCGTCGCAGCCCCTGTCCCTGCGCCCAGA-GGC GTGCCGGCCAGCGGCGGGGGGCGCAGTG-CACACGAGGGGGCTGGACTTCGCCTGTGAT (SEQ ID NO: 67). In some embodiments, the CD8α hinge is encoded by SEQ ID NO: 67.

In some embodiments, the CD28 hinge comprises an amino acid sequence having at least 80% identity, at least 90% identity, at least 95% identity, at least 99% identity or is identical to a sequence of CTIEVMYPPPYLD-NEKSNGTIIHVKGKHLCPSPLFPGPSKP (SEQ ID NO: 68). In some embodiments, the CD28 hinge comprises or consists essentially of SEQ ID NO: 68. In some embodiments, the CD28 hinge is encoded by a nucleotide sequence having at least 80% identity, at least 90% identity, at least 95% identity, at least 99% identity or is identical to a sequence of TGTACCATTGAAGT-TATGTATCCTCCTCCTTACCTAGACAAT-GAGAAGAGCAATGGAACCATTA TCCATGT-GAAAGGGAAACACCTTTGTCCAAGTCCCCTAT-TTCCCGGACCTTCTAAGCCC (SEQ ID NO: 69). In some embodiments, the CD28 hinge is encoded by SEQ ID NO: 69.

The CARs of the present disclosure can be designed to comprise a transmembrane domain that is fused to the extracellular domain of the CAR. In some embodiments, the transmembrane domain that naturally is associated with one of the domains in the CAR is used. For example, a CAR comprising a CD28 co-stimulatory domain might also use a CD28 transmembrane domain. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively, the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

In some embodiments of the CARs of the disclosure, the CARs comprise a CD28 transmembrane domain. In some embodiments, the CD28 transmembrane domain comprises an amino acid sequence having at least 80% identity, at least 90% identity, at least 95% identity, at least 99% identity or is identical to a sequence of FWVLVVVGGVLACYSLL-VTVAFIIFWV (SEQ ID NO: 70). In some embodiments, the CD28 transmembrane domain comprises or consists essentially of SEQ ID NO: 70. In some embodiments, the CD28 transmembrane domain is encoded by a nucleotide sequence having at least 80% identity, at least 90% identity, at least 95% identity, at least 99% identity or is identical to a sequence of TTCTGGGTGCTG-GTCGTTGTGGGCGGCGTGCTGGCCTGCTA-CAGCCTGCTGGTGACAGTGGCCTTCATCATCTTTTG GGTG (SEQ ID NO: 71). In some embodiments, the CD28 transmembrane domain is encoded by SEQ ID NO: 71.

In some embodiments of the CARs of the disclosure, the CARs comprise an IL-2Rbeta transmembrane domain. In some embodiments, the IL-2Rbeta transmembrane domain comprises an amino acid sequence having at least 80% identity, at least 90% identity, at least 95% identity, at least 99% identity or is identical to a sequence of IPWLGHLLL-VGLSGAFGFIILVYLLI (SEQ ID NO: 72). In some embodiments, the IL-2Rbeta transmembrane domain comprises or consists essentially of SEQ ID NO: 72. In some embodiments, the IL-2Rbeta transmembrane domain is encoded by a nucleotide sequence having at least 80% identity, at least 90% identity, at least 95% identity, at least 99% identity or is identical to a sequence of ATTCCGTGGC TCGGCCACCT CCTCGTGGGC CTCAGCGGGG CTTTTGGCTT CATCATCTTA GTGTACTTGC TGATC (SEQ ID NO: 73). In some embodiments, the IL-2Rbeta transmembrane domain is encoded by SEQ ID NO: 73.

The cytoplasmic domain or otherwise the intracellular signaling domain of the CARs of the instant disclosure is responsible for activation of at least one of the normal effector functions of the immune cell in which the CAR has been placed. The term "effector function" refers to a specialized function of a cell. Thus the term "intracellular signaling domain" refers to the portion of a protein which transduces the effector function signal and directs the cell to perform a specialized function. While usually the entire intracellular signaling domain can be employed, in many cases it is not necessary to use the entire domain. To the extent that a truncated portion of the intracellular signaling domain is used, such truncated portion may be used in place of the intact chain as long as it transduces the effector function signal. In some cases, multiple intracellular domains can be combined to achieve the desired functions of the CAR-T cells of the instant disclosure. The term intracellular signaling domain is thus meant to include any truncated portion of one or more intracellular signaling domains sufficient to transduce the effector function signal.

Examples of intracellular signaling domains for use in the CARs of the instant disclosure include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Accordingly, the intracellular domain of CARs of the instant disclosure comprises at least one cytoplasmic activation domain. In some embodiments, the intracellular activation domain ensures that there is T-cell receptor (TCR) signaling necessary to activate the effector functions of the CAR T-cell. In some embodiments, the at least one cytoplasmic activation is a CD247 molecule (CD3ζ) activation domain, a stimulatory killer immunoglobulin-like receptor (KIR) KIR2DS2 activation domain, or a DNAX-activating protein of 12 kDa (DAP12) activation domain.

In some embodiments, the CD3ζ activation domain comprises an amino acid sequence having at least 80% identity, at least 90% identity, at least 95% identity, at least 99% identity or is identical to a sequence of RVKFSRSADAPA-YKQGQNQLYNELNLGRREEYDVLDKRR-GRDPEMGGKPRRKNPQEG LYNELQKDKMAEAYSEI-GMKGERRRGKGHDGLYQGLSTATKDTYDALHM-QALPPR (SEQ ID NO: 74). In some embodiments, the CD3ζ activation domain comprises or consists essentially of SEQ ID NO: 74. In some embodiments, the CD3ζ activation domain is encoded by a nucleotide sequence having at least 80% identity, at least 90% identity, at least 95% identity, at least 99% identity or is identical to a sequence of AGAGT-GAAGTTCAGCAGGAGCGCAGACGCCCCCGCGTA-CAAGCAGGGCCAGAACCAGCTCTATAACGAGCT-CAATCT
AGGACGAAGAGAGGAGTAC-GATGTTTTGGACAAGCGTAGAGGCCGGGACCCT-GAGATGGGGGGAAAGCCGAGAAGGA AGAACCCTCAGGAAGGCCTGTACAAT-GAACTGCAGAAAGATAAGATGGCGGAGGCCTA-CAGTGAGATTGGGATGAAA GGCGAGCGCCG-GAGGGGCAAGGGGCACGATGGCCTTTACCAGG-GACTCAGTACAGCCACCAAGGACACCTACGACGC CCTTCACATGCAGGCCCTGCCCCCTCGC (SEQ ID NO: 75). In some embodiments, the CD3ζ activation domain is encoded by SEQ ID NO: 75.

It is known that signals generated through the TCR alone are often insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs, which are known as immunoreceptor tyrosine-based activation motifs or ITAMs. In some embodiments, the ITAM contains a tyrosine separated from a leucine or an isoleucine by any two other amino acids (YxxL/I) (SEQ ID NO: 157). In some embodiments, the cytoplasmic domain contains 1, 2, 3, 4 or 5 ITAMs. An exemplary ITAM containing cytoplasmic domain is the CD3ζ activation domain. Further examples of ITAM containing primary cytoplasmic signaling sequences that can be used in the CARs of the instant disclosure include those derived from TCRζ, FcRγ, FcRβ, CD3γ, CD3δ, CD3ζ, CD5, CD22, CD79a, CD79b, and CD66d.

In some embodiments, the CD3ζ activation domain comprising a single ITAM comprises an amino acid sequence having at least 80% identity, at least 90% identity, at least 95% identity, at least 99% identity or is identical to a sequence of RVKFSRSADAPAYQQGGQNQLYNELNLGR-REEYDVLHMQALPPR (SEQ ID NO: 76). In some embodiments, the CD3ζ activation domain comprises SEQ ID NO: 76. In some embodiments, the CD3ζ activation domain comprising a single ITAM consists essentially of an amino acid sequence of RVKFSRSADAPAYQQGGQNQLY-NELNLGRREEYDVLHMQALPPR (SEQ ID NO: 76). In some embodiments, the CD3ζ activation domain comprising a single ITAM is encoded by a nucleotide sequence having at least 80% identity, at least 90% identity, at least 95% identity, at least 99% identity or is identical to a sequence of AGAGTGAAGT TCAGCAGGAG CGCAGACGCC CCCGCGTACC AGCAGGGCCA GAACCAGCTC TATAACGAGC TCAATCTAGG ACGAAGAGAG GAGTACGATG TTTTGCACAT GCAGGCCCTG CCCCCTCGC (SEQ ID NO: 77). In some embodiments, the CD3ζ activation domain is encoded by SEQ ID NO: 77.

In some embodiments, the cytoplasmic domain of the CAR can be designed to comprise the CD3ζ signaling domain by itself or combined with any other desired cytoplasmic domain(s) useful in the context of the CAR of the instant disclosure. For example, the cytoplasmic domain of the CAR can comprise a CD3ζ chain portion and a co-stimulatory domain. The co-stimulatory domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include the co-stimulatory domain is selected from the group consisting of IL-2RP, Fc Receptor gamma (FcRγ), Fc Receptor beta (FcRβ), CD3g molecule gamma (CD3γ), CD3δ, CD3ε, CD5 molecule (CD5), CD22 molecule (CD22), CD79a molecule (CD79a), CD79b molecule (CD79b), carcinoembryonic antigen related cell adhesion molecule 3 (CD66d), CD27 molecule (CD27), CD28 molecule (CD28), TNF receptor superfamily member 9 (4-1BB), TNF receptor superfamily member 4 (OX40), TNF receptor superfamily member 8 (CD30), CD40 molecule (CD40), programmed cell death 1 (PD-1), inducible T cell costimulatory (ICOS), lymphocyte function-associated antigen-1 (LFA-1), CD2 molecule (CD2), CD7 molecule (CD7), TNF superfamily member 14 (LIGHT), killer cell lectin like receptor C2 (NKG2C) and CD276 molecule (B7-H3) c-stimulatory domains, or functional fragments thereof. In some embodiments, the intracellular domains of CARs of the instant disclosure comprise at least one co-stimulatory domain. In some embodiments, the co-stimulatory domain is isolated or derived from CD28.

In some embodiments, the intracellular domains of CARs of the instant disclosure comprise at least one co-stimulatory domain. In some embodiments, the co-stimulatory domain is isolated or derived from CD28. In some embodiments, the CD28 co-stimulatory domain comprises an amino acid sequence having at least 80% identity, at least 90% identity, at least 95% identity, at least 99% identity or is identical to a sequence of RSKRSRLLHSDYMNMTPRRPGP-TRKHYQPYAPPRDFAAYRS (SEQ ID NO: 78). In some embodiments, the CD28 co-stimulatory domain comprises or consists essentially of SEQ ID NO: 78. In some embodiments, the CD28 co-stimulatory domain is encoded by a nucleotide sequence having at least 80% identity, at least 90% identity, at least 95% identity, at least 99% identity or is identical to a sequence of AGGAGCAAGCGGAGCA-GACTGCTGCACAGCGACTACATGAA-CATGACCCCCCGGAG GCCTGGCCCCACCCG-GAAGCACTACCAGCCCTACGCCCCTCCCAGGG-ATTTCGCCGC CTACCGGAGC (SEQ ID NO: 79). In some embodiments, the CD28 co-stimulatory domain is encoded by SEQ ID NO: 79. The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker.

In some embodiments, the co-stimulatory domain is isolated or derived from 4-1BB. In some embodiments, the 4-1BB co-stimulatory domain comprises an amino acid sequence having at least 80% identity, at least 90% identity, at least 95% identity, at least 99% identity or is identical to a sequence of KRGRKKLLY-IFKQPFMRPVQTTQEEDGCSCRFPEEEEGGCEL (SEQ ID NO: 159). In some embodiments, the 4-1BB co-stimulatory domain comprises or consists essentially of KRGRKKLLY-IFKQPFMRPVQTTQEEDGCSCRFPEEEEGGCEL (SEQ ID NO: 159). In some embodiments, the 4-1BB co-stimulatory domain s encoded by a nucleotide sequence having at least 80% identity, at least 90% identity, at least 95% identity, at least 99% identity or is identical to a sequence of

```
                                    (SEQ ID NO: 160)
     aaacggggcagaaagaaactcctgtatatattcaaaca accatttatgaggccagtacaaactactcaagaggaag atggctgtagctgccgatttccagaagaagaagaagga ggatgtgaactg.
```

In some embodiments, the intracellular domain of the CAR comprises a CD28 co-stimulatory domain, a 4-1BB costimulatory domain, and a CD3ζ activation domain. In some embodiments, the intracellular domain of the CAR comprises a sequence of RSKRSRLLHSDYMNMT-PRRPGPTRKHYQPYAPPRDFAAYRSKRGRKKLLY-IFKQPFMRP VQTTQEEDGCSCRFPEEEEGGCELRVKFSRSADAPA-YKQGQNQLYNELNLGRREEYDV LDKRR-GRDPEMGGKPRRKNPQEGLYNELQKDKMAEAYSEI-GMKGERRRGKGHDGLY QGLSTATKDTYDALHMQALPPR (SEQ ID NO: 158), or a sequence having at least 80% identity, at least 90% identity, at least 95% identity, at least 99% identity thereto.

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker. An exemplary linker comprises a sequence of GGGGSGGGGSGGGGSGG (SEQ ID NO: 136).

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker.

T Cell Receptors (TCRs)

The disclosure provides a first, activator receptor and immune cells comprising same. In some embodiments, the first receptor is a T cell receptor (TCR).

Exemplary TCRs comprising intracellular domains for use in the instant disclosure are described in PCT/US2020/045250 filed on Sep. 6, 2020, the contents of which are incorporated herein by reference.

As used herein, a "TCR", sometimes also called a "TCR complex" or "TCR/CD3 complex" refers to a protein complex comprising a TCR alpha chain, a TCR beta chain, and one or more of the invariant CD3 chains (zeta, gamma, delta and epsilon), sometimes referred to as subunits. The TCR alpha and beta chains can be disulfide-linked to function as a heterodimer to bind to peptide-MHC complexes. Once the TCR alpha/beta heterodimer engages peptide-MHC, conformational changes in the TCR complex in the associated invariant CD3 subunits are induced, which leads to their phosphorylation and association with downstream proteins, thereby transducing a primary stimulatory signal. In an exemplary TCR complex, the TCR alpha and TCR beta polypeptides form a heterodimer, CD3 epsilon and CD3 delta form a heterodimer, CD3 epsilon and CD3 gamma for a heterodimer, and two CD3 zeta form a homodimer.

Any suitable ligand binding domain may be fused to an extracellular domain, hinge domain or transmembrane of the TCRs described herein. For example, the ligand binding domain can be an antigen binding domain of an antibody or TCR, or comprise an antibody fragment, a Vβ only domain, a linear antibody, a single-chain variable fragment (scFv), or a single domain antibody (sdAb).

In some embodiments, the ligand binding domain is fused to one or more extracellular domains or transmembrane domains of one or more TCR subunits. The TCR subunit can be TCR alpha, TCR beta, CD3 delta, CD3 epsilon, CD3 gamma or CD3 zeta. For example, the ligand binding domain can be fused to TCR alpha, or TCR beta, or portions of the ligand binding can be fused to two subunits, for example portions of the ligand binding domain can be fused to both TCR alpha and TCR beta.

TCR subunits include TCR alpha, TCR beta, CD3 zeta, CD3 delta, CD3 gamma and CD3 epsilon. Any one or more of TCR alpha, TCR beta chain, CD3 gamma, CD3 delta, CD3 epsilon, or CD3 zeta, or fragments or derivative thereof, can be fused to one or more domains capable of providing a stimulatory signal of the disclosure, thereby enhancing TCR function and activity.

TCR transmembrane domains isolated or derived from any source are envisaged as within the scope of the disclosure. The transmembrane domain may be derived either from a natural or from a recombinant source. Where the source is natural, the domain may be derived from any membrane-bound or transmembrane protein.

In some embodiments, the transmembrane domain is capable of signaling to the intracellular domain(s) whenever the TCR complex has bound to a target. A transmembrane domain of particular use in this disclosure may include at least the transmembrane region(s) of e.g., the alpha, beta or zeta chain of the TCR, CD3 delta, CD3 epsilon or CD3 gamma, CD28, CD3 epsilon, CD45, CD4, CD5, CD8, CD9, CD16, CD22, CD33, CD3γ, CD64, CD80, CD86, CD134, CD137, CD154.

In some embodiments, the transmembrane domain can be attached to the extracellular region of a polypeptide of the TCR, e.g., the antigen binding domain of the TCR alpha or beta chain, via a hinge, e.g., a hinge from a human protein. For example, the hinge can be a human immunoglobulin (Ig) hinge, e.g., an IgG4 hinge, or a CD8α hinge. In some embodiments, the hinge is isolated or derived from CD8α or CD28.

In some embodiments, the extracellular ligand binding domain is attached to one or more transmembrane domains of the TCR. In some embodiments, the transmembrane domain comprises a TCR alpha transmembrane domain, a TCR beta transmembrane domain, or both. In some embodiments, the transmembrane comprises a CD3 zeta transmembrane domain.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 or up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 or up to 15 amino acids of the intracellular region).

In some embodiments, the transmembrane domain can be selected or modified by amino acid substitution to avoid binding of such domains to the transmembrane domains of the same or different surface membrane proteins, e.g., to minimize interactions with other members of the receptor complex.

When present, the transmembrane domain may be a natural TCR transmembrane domain, a natural transmembrane domain from a heterologous membrane protein, or an artificial transmembrane domain. The transmembrane domain may be a membrane anchor domain. Without limitation, a natural or artificial transmembrane domain may comprise a hydrophobic a-helix of about 20 amino acids, often with positive charges flanking the transmembrane segment. The transmembrane domain may have one transmembrane segment or more than one transmembrane segment. Prediction of transmembrane domains/segments may be made using publicly available prediction tools (e.g. TMHMM, Krogh et al. Journal of Molecular Biology 2001; 305(3):567-580; or TMpred, Hofmann & Stoffel Biol. Chem. Hoppe-Seyler 1993; 347: 166). Non-limiting examples of membrane anchor systems include platelet derived growth factor receptor (PDGFR) transmembrane domain, glycosylphosphatidylinositol (GPI) anchor (added post-translationally to a signal sequence) and the like.

In some embodiments, the transmembrane domain comprises a TCR alpha transmembrane domain. In some embodiments, the TCR alpha transmembrane domain comprises an amino acid sequence having at least 85% identity, at least 90% identity, at least 95% identity, at least 96% identity, at least 97% identity, at least 98% identity, at least 99% identity or is identical to a sequence of: VIGFRILLLK-VAGFNLLMTLRLW (SEQ ID NO: 80). In some embodiments, the TCR alpha transmembrane domain comprises, or consists essentially of, SEQ ID NO: 80. In some embodiments, the TCR alpha transmembrane domain is encoded by a sequence of (SEQ ID NO: 81)
GTGATTGGGTTCCGAATCCTCCTCCTGAAAGTGGCCGG

GTTTAATCTGCTCATGACGCTGCGGCTGTGG.

In some embodiments, the transmembrane domain comprises a TCR beta transmembrane domain. In some embodiments, the TCR beta transmembrane domain comprises an amino acid sequence having at least 85% identity, at least 90% identity, at least 95% identity, at least 96% identity, at least 97% identity, at least 98% identity, at least 99% identity or is identical to a sequence of: TILYEILLGKATLYAVLVSALVL (SEQ ID NO: 82). In some embodiments, the TCR beta transmembrane domain comprises, or consists essentially of, SEQ ID NO: 82. In some embodiments, the TCR beta transmembrane domain is encoded by a sequence of

```
                                        ( SEQ ID NO: 83)
ACCATCCTCTATGAGATCTTGCTAGGGAAGGCCACCTT

GTATGCCGTGCTGGTCAGTGCCCTCGTGCTG.
```

TCRs of the disclosure can comprise one or more intracellular domains. In some embodiments, the intracellular domain comprises one or more domains capable of providing a stimulatory signal to a transmembrane domain. In some embodiments, the intracellular domain comprises a first intracellular domain capable of providing a stimulatory signal and a second intracellular domain capable of providing a stimulatory signal. In other embodiments, the intracellular domain comprises a first, second and third intracellular domain capable of providing a stimulatory signal. The intracellular domains capable of providing a stimulatory signal are selected from the group consisting of a CD28 molecule (CD28) domain, a LCK proto-oncogene, Src family tyrosine kinase (Lck) domain, a TNF receptor superfamily member 9 (4-1BB) domain, a TNF receptor superfamily member 18 (GITR) domain, a CD4 molecule (CD4) domain, a CD8a molecule (CD8a) domain, a FYN proto-oncogene, Src family tyrosine kinase (Fyn) domain, a zeta chain of T cell receptor associated protein kinase 70 (ZAP70) domain, a linker for activation of T cells (LAT) domain, lymphocyte cytosolic protein 2 (SLP76) domain, (TCR) alpha, TCR beta, CD3 delta, CD3 gamma and CD3 epsilon intracellular domains.

In some embodiments, an intracellular domain comprises at least one intracellular signaling domain. An intracellular signaling domain generates a signal that promotes a function a cell, for example an immune effector function of a TCR containing cell, e.g., a TCR-expressing T-cell. In some embodiments, the intracellular domain of the first receptor of the disclosure includes at least one intracellular signaling domain. For example, the intracellular domains of CD3 gamma, delta or epsilon comprise signaling domains.

In some embodiments, the extracellular domain, transmembrane domain and intracellular domain are isolated or derived from the same protein, for example T-cell receptor (TCR) alpha, TCR beta, CD3 delta, CD3 gamma, CD3 epsilon or CD3 zeta.

Examples of intracellular domains for use in activator receptors of the disclosure include the cytoplasmic sequences of the TCR alpha, TCR beta, CD3 zeta, and 4-1BB, and the intracellular signaling co-receptors that act in concert to initiate signal transduction following antigen receptor engagement, as well as any derivative or variant of these sequences and any recombinant sequence that has the same functional capability.

In some embodiments, the intracellular signaling domain comprises a primary intracellular signaling domain. Exemplary primary intracellular signaling domains include those derived from the proteins responsible for primary stimulation, or antigen dependent stimulation.

In some embodiments, the intracellular domain comprises a CD3 delta intracellular domain, a CD3 epsilon intracellular domain, a CD3 gamma intracellular domain, a CD3 zeta intracellular domain, a TCR alpha intracellular domain or a TCR beta intracellular domain.

In some embodiments, the intracellular domain comprises a TCR alpha intracellular domain. In some embodiments, a TCR alpha intracellular domain comprises Ser-Ser. In some embodiments, a TCR alpha intracellular domain is encoded by a sequence of TCCAGC.

In some embodiments, the intracellular domain comprises a TCR beta intracellular domain. In some embodiments, the TCR beta intracellular domain comprises an amino acid sequence having at least 80% identity, at least 90% identity, or is identical to a sequence of: MAMVKRKDSR (SEQ ID NO: 84). In some embodiments, the TCR beta intracellular domain comprises, or consists essentially of SEQ ID NO: 84. In some embodiments, the TCR beta intracellular domain is encoded by a sequence of

```
                                    (SEQ ID NO: 85)
ATGGCCATGGTCAAGAGAAAGGATTCCAGA.
```

In some embodiments, the intracellular signaling domain comprises at least one stimulatory intracellular domain. In some embodiments, the intracellular signaling domain comprises a primary intracellular signaling domain, such as a CD3 delta, CD3 gamma and CD3 epsilon intracellular domain, and one additional stimulatory intracellular domain, for example a co-stimulatory domain. In some embodiments, the intracellular signaling domain comprises a primary intracellular signaling domain, such as a CD3 delta, CD3 gamma and CD3 epsilon intracellular domain, and two additional stimulatory intracellular domains.

Exemplary co-stimulatory intracellular signaling domains include those derived from proteins responsible for co-stimulatory signals, or antigen independent stimulation. Co-stimulatory molecules include, but are not limited to an MHC class I molecule, BTLA, a Toll ligand receptor, as well as DAP10, DAP12, CD30, LIGHT, OX40, CD2, CD27, CDS, ICAM-1, LFA-1 (CD11a/CD18) 4-1BB (CD137, TNF receptor superfamily member 9), and CD28 molecule (CD28). A co-stimulatory protein can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, a ligand that specifically binds with CD83, CD4, and the like. The co-stimulatory domain can comprise the entire intracellular portion, or the entire native intracellular signaling domain, of the molecule from which it is derived, or a functional variant thereof.

In some embodiments, the stimulatory domain comprises a co-stimulatory domain. In some embodiments, the co-stimulatory domain comprises a CD28 or 4-1BB co-stimulatory domain. CD28 and 4-1BB are well characterized co-stimulatory molecules required for full T cell activation and known to enhance T cell effector function. For example, CD28 and 4-1BB have been utilized in chimeric antigen receptors (CARs) to boost cytokine release, cytolytic function, and persistence over the first-generation CAR containing only the CD3 zeta signaling domain. Likewise, inclusion of co-stimulatory domains, for example CD28 and 4-1BB domains, in TCRs can increase T cell effector function and specifically allow co-stimulation in the absence of co-stimulatory ligand, which is typically down-regulated on the surface of tumor cells. In some embodiments, the stimulatory domain comprises a CD28 intracellular domain or a 4-1BB intracellular domain.

Inhibitory Receptors

The disclosure provides a second receptor, comprising an extracellular ligand binding domain specific to a non-target antigen that has been lost in a cancer cell, such as an allelic variant of a gene. The non-target allelic variant can be lost in the cancer cell through any mechanism, such as, without limitation, epigenetic changes that effect non-target allelic variant expression, mutations to the gene encoding the non-target allelic variant, disruption of cellular signaling that regulates expression of the non-target allelic variant, chromosome loss, partial or complete deletion of the genomic locus, gene silencing through modification of nucleic acids or heterochromatin, or loss of expression through other mechanisms. In variations of the compositions and methods disclosed herein, the cells or subject treated may exhibit a loss of expression of the non-target allelic variant because of non-genetic changes. Accordingly the disclosure provides compositions and methods for killing cells and/or treating subject lacking expression of the non-target antigen from any cause, including but not limited to, loss of heterozygosity.

The non-target antigen can be a protein, or an antigen peptide thereof in a complex with a major histocompatibility complex class I (MHC-I), where the non-target antigen comprises a polymorphism. Because the non-target antigen is polymorphic, loss of a single copy of the gene encoding the non-target antigen, which may occur through loss of heterozygosity in a cancer cell, yields a cancer cell that retains the other polymorphic variant of gene, but has lost the non-target antigen. For example, a subject having HLA-A*02 and HLA-A*01 alleles at the HLA locus may have a cancer in which only the HLA-A*02 allele is lost. In such a subject, the HLA-A*01 protein remains present, but is not recognized by the inhibitory receptor of immune cells encountering the cancer cell, because the inhibitor receptor is designed to be specific to the HLA-A*02 (or other non-target antigen). In normal non-malignant cells, the HLA-A*02 (or other non-target antigen) is present and inhibits activation of the engineered immune cell. In cancer cells having loss of heterozygosity, the HLA-A*02 allelic variant (or other non-target antigen) is lost. Immune cells engineered to express the inhibitory receptor do not receive an inhibitory signal from the inhibitory receptor, as the inhibitory receptor only responds to the HLA-A*02 (or other non-target antigen), which is absent on cancer cells. By this mechanism, the immune cell is selectively activated, and selectively kills, cancer cells expressing EGFR but having lost HLA-A*02 (or another non-target antigen) due to loss-of-heterozygosity. HLA-A is used here as an example. Similar polymorphic variation occurs in the population at other MHC genes and in other non-MHC genes as well. Accordingly, in some embodiments, the non-target antigen comprises a polymorphic variant of COLEC12, APCDD1 or CXCL16, or HLA-A*02. In some embodiments, the non-target antigen is an HLA class I allele or a minor histocompatibility antigen (MiHA). In some embodiments, the HLA Class I allele comprises HLA-A, HLA-B, HLA-C, or HLA-E. In some embodiments, the HLA class I allele is HLA-A*02. In some embodiments, the HLA-A*02 non-target antigen is expressed by healthy cells of a subject. In some embodiments, the non-target antigen is a non-target allelic variant. In some embodiments, the non-target antigen is not expressed in a cancer cell of the subject. In some embodiments, the non-target antigen is not expressed in a fraction of the cells in a tumor in the subject. In some embodiments, a cancer cell in a subject has lost expression of the non-target antigen. Loss of expression or lack of expression of the non-target antigen in a cell can be by any mechanism, such as, without limitation, epigenetic changes that effect non-target gene expression, mutations to the gene encoding the non-target antigen, or disruption of cellular signaling that regulates expression of the non-target gene.

In some embodiments, the second receptor is an inhibitory chimeric antigen receptor (i.e. inhibitory receptor). In some embodiments, the second receptor is an inhibitory receptor. In some embodiments, the second receptor is humanized.

In some embodiments, the second receptor comprises SEQ ID NO: 173, or a sequence sharing at least 75%, at least 80%, at least 85%, at least 90%, at least 95%, or at least 98% identity thereto. In some embodiments, 174 or a sequence sharing at least 75%, at least 80%, at least 85%, at least 90%, at least 95%, or at least 98% identity thereto.

The disclosure provides a second receptor, which is an inhibitory receptor, comprising an extracellular ligand binding that can discriminate between single amino-acid variant alleles of a non-target antigen. This ability to discriminate between allelic variants of a non-target antigen allows the second receptor to inhibit activation of immune cells comprising the second receptor in the presence of non-target cells that express that the allele recognized by the ligand binding domain. However, activation of immune cells is not inhibited in the presence of target cells that have lost the allele, for example cancer cells that have lost one allele of a gene through loss of heterozygosity.

The disclosure provides a second receptor, which is an inhibitory receptor, comprising an extracellular ligand binding that can discriminate between different levels of expression of a non-target antigen. This allows the second receptor to inhibit activation of immune cells comprising the second receptor in the presence of non-target cells that express the ligand for the second receptor, but to allow activation of immune cells in the presence of cancer cells that express low levels, or have no expression, of the ligand for the second receptor.

Inhibitor Ligands

In some embodiments, the non-target antigen is not expressed by the target cells, and is expressed by non-target cells. In some embodiments, the non-target antigen is expressed by healthy cells, i.e. cells that are not cancer cells. In some embodiments, the target cells are a plurality of cancer cells that have lost expression of the non-target antigen through loss of heterozygosity (LOH). In some embodiments, the non-target cells are a plurality of healthy cells (i.e., non-cancer, normal, or healthy cells), that express both the target and the non-target antigen.

Any cell surface molecule expressed by the non-target cells that is not expressed by target cells may be a suitable non-target antigen for the second receptor extracellular ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a non-target antigen.

In some embodiments, the target antigen is a peptide antigen of a cancer cell-specific antigen in a complex with a major histocompatibility complex class I (MHC-I).

In some embodiments, the non-target antigen is lost in the cancer cells due to loss of heterozygosity. Exemplary non-target antigens lost in cancer cells due to loss of heterozygosity include COLEC12, APCDD1, CXCL16 and HLA-A*02. In some embodiments, the non-target antigen is selected from the group consisting of a polymorphic variant of COLEC12, APCDD1 and CXCL166, or a peptide antigen thereof a complex with a major histocompatibility complex class I (MHC-I), or HLA-A*02. In some embodiments, the non-target antigen is an antigen peptide comprising a polymorphic residue of COLEC12, APCDD1 and CXCL16 in a complex with a major histocompatibility complex class I (MHC-I).

Non-target MHC-1 (MHC) antigens comprising any of HLA-A, HLA-B or HLA-C are envisaged as within the scope of the disclosure. In some embodiments, the non-target antigen comprises HLA-A. In some embodiments, the non-target antigen comprises a human leukocyte antigen A*02 allelic product (HLA-A*02). In some embodiments, the non-target antigen comprises human leukocyte antigen A*69. In some embodiments, the non-target antigen comprises HLA-B. In some embodiments, the non-target antigen comprises HLA-C.

In some embodiments, the non-target antigen comprises HLA-A*02.

In some embodiments, the non-target antigen comprises C-X-C motif chemokine ligand 16 (CXCL16) or an antigen peptide thereof in a complex with MHC-I. Human CXCL16 precursor is described in NCBI record number NP_001094282.1, the contents of which are incorporated by reference herein in their entirety. In some embodiments, CXCL16 comprises an amino acid sequence of:

```
                                        (SEQ ID NO: 86)
  1 MSGSQSEVAP SPQSPRSPEM GRDLRPGSRV

LLLLLLLLLV YLTQPGNGNE GSVTGSCYCG

61 KRISSDSPPS VQFMNRLRKH LRAYHRCLYY

TRFQLLSWSV CGGNKDPWVQ ELMSCLDLKE

121 CGHAYSGIVA HQKHLLPTSP PISQASEGAS

SDIHTPAQML LSTLQSTQRP TLPVGSLSSD

181 KELTRPNETT IHTAGHSLAA GPEAGENQKQ

PEKNAGPTAR TSATVPVLCL LAIIFILTAA

241 LSYVLCKRRR GQSPQSSPDL PVHYIPVAPD

SNT.
```

In some embodiments, the non-target antigen comprises a polymorphism of CXCL16. For example, the non-target antigen comprises a peptide derived from CXCL16 comprising a polymorphic residue of CXCL16. Polymorphic residues of CXCL16 include positions 142 and 200 of SEQ ID NO: 86. In some embodiments, the non-target antigen comprises a peptide of CXCL16 comprising amino acid 142 or 200 of SEQ ID NO: 86. In some embodiments, the non-target antigen comprises a peptide of CXCL16 comprising an A at amino acid 200 of SEQ ID NO: 86. In some embodiments, the non-target antigen comprises a peptide of CXCL16 comprising a V at amino acid 200 of SEQ ID NO: 86. In some embodiments, the non-target antigen comprises a peptide of CXCL16 comprising an I at amino acid 142 of SEQ ID NO: 86. In some embodiments, the non-target antigen comprises a peptide of CXCL16 comprising a T at amino acid 142 of SEQ ID NO: 86.

In some embodiments, the non-target antigen comprises a polymorphism of CXCL16. In some embodiments, the non-target antigen comprises a peptide of CXCL16 comprising an A at amino acid 200 of SEQ ID NO: 86, and the second receptor comprises a ligand binding domain with a higher affinity for a CXCL16 ligand with an A at position 200 of SEQ ID NO: 86 than for a CXCL16 ligand with a V at position 200 of SEQ ID NO: 86. In some embodiments, the non-target antigen comprises a peptide of CXCL16 comprising a V at amino acid 200 of SEQ ID NO: 86, and the second receptor comprises a ligand binding domain with a higher affinity for a CXCL16 ligand with a V at position 200 of SEQ ID NO: 86 than for a CXCL16 ligand with an A at position 200 of SEQ ID NO: 86. In some embodiments, the non-target antigen comprises a peptide of CXCL16 comprising an I at amino acid 142 of SEQ ID NO: 86, and the second receptor comprises a ligand binding domain with a higher affinity for a CXCL16 ligand with an I at position 142 of SEQ ID NO: 86 than for a CXCL16 ligand with a T at position 142 of SEQ ID NO: 86. In some embodiments, the non-target antigen comprises a peptide of CXCL16 comprising a T at amino acid 142 of SEQ ID NO: 86, and the second receptor comprises a ligand binding domain with a higher affinity for a CXCL16 ligand with a T at position 142 of SEQ ID NO: 86 than for a CXCL16 ligand with an I at position 142 of SEQ ID NO: 86.

In some embodiments, the non-target antigen comprises collectin subfamily member 12 (COLEC12) or an antigen peptide thereof in a complex with MHC-I. Human COLEC12 is described in NCBI record number NP_569057.2, the contents of which are incorporated by reference herein in their entirety. In some embodiments, COLEC12 comprises an amino acid sequence of:

```
                                        (SEQ ID NO: 87)
  1 MKDDFAEEEE VQSFGYKRFG IQEGTQCTKC

KNNWALKFSI ILLYILCALL TITVAILGYK

61 VVEKMDNVTG GMETSRQTYD DKLTAVESDL

KKLGDQTGKK AISTNSELST FRSDILDLRQ

121 QLREITEKTS KNKDTLEKLQ ASGDALVDRQ

SQLKETLENN SFLITTVNKT LQAYNGYVTN

181 LQQDTSVLQG NLQNQMYSHN VVIMNLNNLN

LTQVQQRNLI TNLQRSVDDT SQAIQRIKND

241 FQNLQQVFLQ AKKDTDWLKE KVQSLQTLAA

NNSALAKANN DTLEDMNSQL NSFTGQMENI

301 TTISQANEQN LKDLQDLHKD AENRTAIKFN

QLEERFQLFE TDIVNIISNI SYTAHHLRTL

361 TSNLNEVRTT CTDTLTKHTD DLTSLNNTLA

NIRLDSVSLR MQQDLMRSRL DTEVANLSVI

421 MEEMKLVDSK HGQLIKNFTI LQGPPGPRGP

RGDRGSQGPP GPTGNKGQKG EKGEPGPPGP
```

-continued

```
481 AGERGPIGPA GPPGERGGKG SKGSQGPKGS

RGSPGKPGPQ GSSGDPGPPG PPGKEGLPGP

541 QGPPGFQGLQ GTVGEPGVPG PRGLPGLPGV

PGMPGPKGPP GPPGPSGAVV PLALQNEPTP

601 APEDNGCPPH WKNFTDKCYY FSVEKEIFED

AKLFCEDKSS HLVFINTREE QQWIKKQMVG

661 RESHWIGLTD SERENEWKWL DGTSPDYKNW

KAGQPDNWGH GHGPGEDCAG LIYAGQWNDF

721 QCEDVNNFIC EKDRETVLSS AL.
```

In some embodiments, the non-target antigen comprises a polymorphism of COLEC12. For example, the non-target antigen comprises a peptide derived from COLEC12 comprising a polymorphic residue of COLEC12. Polymorphic residues of COLEC12 include position 522 of SEQ ID NO: 87. In some embodiments, the non-target antigen comprises a peptide of COLEC12 comprising amino acid 522 of SEQ ID NO: 87. In some embodiments, the non-target antigen comprises a peptide of COLEC12 comprising an S at amino acid 522 of SEQ ID NO: 87. In some embodiments, the non-target antigen comprises a peptide of COLEC12 comprising a P at amino acid 522 of SEQ ID NO: 87.

In some embodiments, the non-target antigen comprises APC down-regulated 1 (APCDD1) or an antigen peptide thereof in a complex with MHC-I. An exemplary human APCDD1 is described in UniProtKB record number Q8J025, the contents of which are incorporated by reference herein in their entirety. In some embodiments, APCDD1 comprises an amino acid sequence of:

```
                                         (SEQ ID NO: 88)
  1 MSWPRRLLLR YLFPALLLHG LGEGSALLHP

DSRSHPRSLE KSAWRAFKES QCHHMLKHLH

61 NGARITVQMP PTIEGHWVST GCEVRSGPEF

ITRSYRFYHN NTFKAYQFYY GSNRCTNPTY

121 TLIIRGKIRL RQASWIIRGG TEADYQLHNV

QVICHTEAVA EKLGQQVNRT CPGFLADGGP

181 WVQDVAYDLW REENGCECTK AVNFAMHELQ

LIRVEKQYLH HNLDHLVEEL FLGDIHTDAT

241 QRMFYRPSSY QPPLQNAKNH DHACIACRII

YRSDEHHPPI LPPKADLTIG LHGEWVSQRC

301 EVRPEVLFLT RHFIFHDNNN TWEGHYYHYS

DPVCKHPTFS IYARGRYSRG VLSSRVMGGT

361 EFVFKVNHMK VTPMDAATAS LLNVFNGNEC

GAEGSWQVGI QQDVTHTNGC VALGIKLPHT

421 EYEIFKMEQD ARGRYLLFNG QRPSDGSSPD

RPEKRATSYQ MPLVQCASSS PRAEDLAEDS

481 GSSLYGRAPG RHTWSLLLAA LACLVPLLHW

NIRR.
```

In some embodiments, the non-target antigen comprises a polymorphism of APCDD1. Exemplary polymorphisms of APCDD1 include rs3748415, which can be a V, I or L at position 150 of SEQ ID NO: 88. In some embodiments, the non-target antigen comprises a peptide of APCDD1 comprising amino acid 150 of SEQ ID NO: 88. In some embodiments, the non-target antigen comprises a peptide of APCDD1 comprising an V at amino acid 150 of SEQ ID NO: 88. In some embodiments, the non-target antigen comprises a peptide of APCDD1 comprising an I at amino acid 150 of SEQ ID NO: 88. In some embodiments, the non-target antigen comprises a peptide of APCDD1 comprising an L at amino acid 150 of SEQ ID NO: 88.

A further exemplary human APCDD1 is described in UniProtKB record number V9GY82, the contents of which are incorporated by reference herein in their entirety. In some embodiments, APCDD1 comprises an amino acid sequence of:

```
                                        (SEQ ID NO: 134)
  1 XDVAYDLWRE ENGCECTKAV NFAMHELQLI

RVEKQYLHHN LDHLVEELFL GDIHTDATQR

61 MFYRPSSYQP PLQNAKCAAE SSGSFQILPQ

DSSEKEQNGL SHWCLSRPGH QKDWALCAHA

121 GPATAGCPSC LWPPAETGRK AGRTSSKTVH

ACPGEAGTSS FELEYFPNCW SIETKLKISL

181 NAKLSFKPRA SAPLETGHRV KIETLSQLVF

LSFIQLCCEV QSPLANK.
```

Exemplary polymorphisms of APCDD1 include rs1786683, which can be a Y or S at position 165 of SEQ ID NO: 133. In some embodiments, the non-target antigen comprises a peptide of APCDD1 comprising amino acid 165 of SEQ ID NO: 134. In some embodiments, the non-target antigen comprises a peptide of APCDD1 comprising a Y at amino acid 165 of SEQ ID NO: 134. In some embodiments, the non-target antigen comprises a peptide of APCDD1 comprising an S at amino acid 165 of SEQ ID NO: 134.

A further exemplary human APCDD1 is described in UniProt record number J3QSE3, the contents of which are incorporated by reference herein in their entirety. In some embodiments APCDD1 comprises an amino acid sequence of:

```
                                        (SEQ ID NO: 135)
  1 PEDVLPALQL PAPSAECQVE MGFHHVGQDG

LQLPTSSDPP ALASQSAGIT GVSHRPPGRH

61 LSNDLRTTTM PASPVGSSIG QTSTTLPSCP

QRQT.
```

Exemplary polymorphisms of APCDD1 include rs9952598, which can be a Q or R at position 28 of SEQ ID NO: 135. In some embodiments, the non-target antigen comprises a peptide of APCDD1 comprising amino acid 28 of SEQ ID NO: 135. In some embodiments, the non-target antigen comprises a peptide of APCDD1 comprising a Q at amino acid 28 of SEQ ID NO: 135. In some embodiments, the non-target antigen comprises a peptide of APCDD1 comprising an R at amino acid 28 of SEQ ID NO: 135.

In some embodiments, APCDD1 comprises a sequence that shares at least 80%, at least 85%, at least 90%, at least 95%, at least 94%, at least 97%, at least 98%, or at least 99% identity to any one of SEQ ID NOs: 88 or 134-135. Polymorphic residues of APCDD1 are marked as bold and underlined in SEQ ID NOs: 88 or 134-135.

In some embodiments, the non-target antigen comprises HLA-A*02. Various single variable domains known in the art or disclosed herein that bind to and recognize HLA-A*02 are suitable for use in embodiments.

In some embodiments, the non-target antigen comprises HLA-B*07. Various single variable domains known in the art or disclosed herein that bind to and recognize HLA-B*07 are suitable for use in embodiments.

In some embodiments, the non-target antigen comprises HLA-A*11. Various single variable domains known in the art or disclosed herein that bind to and recognize HLA-A*11 are suitable for use in embodiments.

In some embodiments, the non-target antigen comprises HLA-A*01. Various single variable domains known in the art or disclosed herein that bind to and recognize HLA-A*01 are suitable for use in embodiments.

In some embodiments, the non-target antigen comprises HLA-A*03. Various single variable domains known in the art or disclosed herein that bind to and recognize HLA-A*03 are suitable for use in embodiments.

In some embodiments, the non-target antigen comprises HLA-C*07. Various single variable domains known in the art or disclosed herein that bind to and recognize HLA-C*07 are suitable for use in embodiments.

Such scFvs include, for example and without limitation, the following mouse and humanized scFv antibodies that bind non-target antigens (e.g. HLA-A*02, HLA-A*01, HLA-A*03, HLA-A*11, HLA-B*07, or HLA-C*07) in a peptide-independent way shown in Table 4 below (where indicated, complementarity determining regions underlined):

TABLE 4

| scFv binding domains | |
|---|---|
| HLA-A*02 antigen binding domains | |
| C-001765 PA2.1 scFv (mouse) | DVLMTQTPLSLPVSLGDQASISCRSSQSIVHSNGNTYLEWYL QKPGQSPKLLIYKVSNRFSGVPDRFSGSGSGTDFTLKISRVE AEDLGVYYCFQGSHVPRTSGGGTKLEIKGGGGSGGGGSGG GGSGGGVQLQQSGPELVKPGASVRISCKASGYTFTSYHIHW VKQRPGQGLEWIGWIYPGNVNTEYNEKFKGKATLTADKSS STAYMHLSSLTSEDSAVYFCAREEITYAMDYWGQTSVTV SS (SEQ ID NO: 89) |
| C-002159 PA2.1.8 scFv (humanized) | QVQLVQSGAEVKKPGSSVKVSCKASGYTFTSYHIHWVRQA PGQGLEWMGWIYPGNVNTEYNEKFKGKATITADKSTSTAY MELSSLRSEDTAVYYCAREEITYAMDYWGQGTTVTVSSGG GGSGGGGSGGGGSGGEIVLTQSPGTLSLSPGERATLSCRSSQ SIVHSNGNTYLEWYQQKPGQAPRLLIYKVSNRFSGIPDRFSG SGSGTDFTLTISRLEPEDFAVYYCFQGSHVPRTFGGGTKVEI K (SEQ ID NO: 90) |
| C-002160 PA2.1.9 scFv (humanized) | C-002160 PA2.1.9 scFv (humanized): QVQLVQSGAEVKKPGSSVKVSCKASGYTFTSYHIHWVRQA PGQGLEWMGWIYPGNVNTEYNEKFKGKATITADKSTSTAY MELSSLRSEDTAVYYCAREEITYAMDYWGQGTTVTVSSGG GGSGGGGSGGGGSGGDIVMTQTPLSLPVTPGEPASISCRSSQ SIVHSNGNTYLEWYLQKPGQSPQLLIYKVSNRFSGVPDRFSG SGSGTDFTLKISRVEAEDVGVYYCFQGSHVPRTFGGGTKVEI K (SEQ ID NO: 91) |
| C-002161 PA2.1.10 scFv (humanized) | EVQLVESGGGLVKPGGSLRLSCAASGYTFTSYHIHWVRQAP GKGLEWVGWIYPGNVNTEYNEKFKGRFTISRDDSKNTLYL QMNSLKTEDTAVYYCAREEITYAMDYWGQGTTVTVSSGG GGSGGGGSGGGGSGGDIQMTQSPSSLSASVGDRVTITCRSS QSIVHSNGNTYLEWYQQKPGKAPKLLIYKVSNRFSGVPSRF SGSGSGTDFTLTISSLQPEDFATYYCFQGSHVPRTFGGGTKV EIK (SEQ ID NO: 92) |
| C-002162 PA2.1.14 ScFv (humanized) | QVQLVQSGAEVKKPGSSVKVSCKASGYTFTSYHIHWVRQA PGQGLEWIGWIYPGNVNTEYNEKFKGKATITADESTNTAY MELSSLRSEDTAVYYCAREEITYAMDYWGQGTLVTVSSGG GGSGGGGSGGGGSGGDIQMTQSPSTLSASVGDRVTITCRSS QSIVHSNGNTYLEWYQQKPGKAPKLLIYKVSNRFSGVPARF SGSGSGTEFTLTISSLQPDDFATYYCFQGSHVPRTFGQGTKV EVK (SEQ ID NO: 93) |
| C-002163 PA2.1.18 ScFv (humanized) | QVQLVQSGAEVKKPGSSVKVSCKASGYTFTSYHMHWVRQ APGQGLEWIGYIYPGNVNTEYNEKFKGKATLTADKSTNTA YMELSSLRSEDTAVYFCAREEITYAMDYWGQGTLVTVSSG GGGSGGGGSGGGGSGGDVQMTQSPSTLSASVGDRVTITCSS SQSIVHSNGNTYMEWYQQKPGKAPKLLIYKVSNRFSGVPDR FSGSGSGTEFTLTISSLQPDDFATYYCHQGSHVPRTFGQGTK VEVK (SEQ ID NO: 94) |

TABLE 4-continued scFv binding domains

HLA-A*02 antigen binding domains derived from BB7.2 mAb

C-002164
BB7.2 scFv
(mouse):
QVQLQQSGPELVKPGASVKMSCKA<u>SGYTFTSYHIQ</u>WVKQR
PGQGLEWIG<u>WIYPGDGSTQYNEKFKG</u>KTTLTADKSSSTAY
MLLSSLTSEDSAIYFCAR<u>EGTYYAMDY</u>WGQGTSVTVSSGG
GGSGGGGSGGGGSGGDVLMTQTPLSLPVSLGDQVSISC<u>RSS
QSIVHSNGNTYLE</u>WYLQKPGQSPKLLIY<u>KVSNRFS</u>GVPDRFS
GSGSGTDFTLKISRVEAEDLGVYYC<u>FQGSHVPRT</u>FGGGTKL
EIK (SEQ ID NO: 95)

C-002165
BB7.2.1 scFv
(humanized)
QLQLQESGPGLVKPSETLSLTCTV<u>SGYTFTSYHIQ</u>WIRQPPG
KGLEWIG<u>WIYPGDGSTQYNEKFKG</u>RATISVDTSKNQFSLNL
DSVSAADTAIYYCAR<u>EGTYYAMDY</u>WGKGSTVTVSSGGGGSG
GGGSGGGGSGGDIQMTQSPSSLSASVGDRVTITC<u>RSSQSI
VHSNGNTYLE</u>WYQQKPGKAPKLLIY<u>KVSNRFSGVPSR</u>FSGS
GSGTDFTFTISSLQPEDIATYYC<u>FQGSHVPRT</u>FGPGTKVDIK
(SEQ ID NO: 96)

C-002166
BB7.2.2 scFv
(humanized)
EVQLVQSGAELKKPGSSVKVSCKA<u>SGYTFTSYHIQ</u>WVKQA
PGQGLEWIG<u>WIYPGDGSTQYNEKFKG</u>KATLTVDKSTNTAY
MELSSLRSEDTAVYYCAR<u>EGTYYAMDY</u>WGQGTLVTVSSGG
GGSGGGGSGGGGSGGDIQMTQSPSTLSASVGDRVTITC<u>RS
SQSIVHSNGNTYLE</u>WYQQKPGKAPKLLIY<u>KVSNRFS</u>GVPSR
FSGSGSGTDFTLTISSLQPDDFATYYC<u>FQGSHVPRT</u>FGQGTK
VEVK (SEQ ID NO: 97)

C-002167
BB7.2.3 scFv
(humanized):
QVQLVQSGAEVKKPGSSVKVSCKA<u>SGYTFTSYHIQ</u>WVRQA
PGQGLEWMG<u>WIYPGDGSTQYNEKFKG</u>RVTITADKSTSTAY
MELSSLRSEDTAVYYCAR<u>EGTYYAMDY</u>WGQGTTVTVSSG
GGGSGGGGSGGGGSGGEIVLTQSPGTLSLSPGERATLSC<u>RSS
QSIVHSNGNTYLE</u>WYQQKPGQAPRLLIY<u>KVSNRFSGIPDR</u>FS
GSGSGTDFTLTISRLEPEDFAVYYC<u>FQGSHVPRT</u>FGGGTKVE
IK (SEQ ID NO: 98)

C-002168
BB7.2.5 scFv
(humanized)
QVTLKQSGAEVKKPGSSVKVSCTA<u>SGYTFTSYHVS</u>WVRQA
PGQGLEWLG<u>RIYPGDGSTQYNEKFKG</u>KVTITADKSMDTSF
MELTSLTSEDTAVYYCAR<u>EGTYYAMDL</u>WGQGTLVTVSSG
GGGSGGGGSGGGGSGGEIVLTQSPGTLSLSPGERATLSC<u>RSS
QSIVHSNGNTYLA</u>WYQQKPGQAPRLLIS<u>KVSNRFSGVPDR</u>F
SGSGSGTDFTLTISRLEPEDFAVYYC<u>QQGSHVPRT</u>FGGGTKV
EIK (SEQ ID NO: 99)

C-002169
BB7.2.6 scFv
(humanized)
QVQLVQSGAEVKKPGASVKVSCKA<u>SGYTFTSYHMH</u>WVRQ
APGQRLEWMG<u>WIYPGDGSTQYNEKFKG</u>KVTITRDTSASTA
YMELSSLRSEDTAVYYCAR<u>EGTYYAMDY</u>WGQGTLVTVSS
GGGGSGGGGSGGGGSGGDIVMTQTPLSLPVTPGEPASISC<u>RS
SQSIVHSNGNTYLD</u>WYLQKPGQSPQLLIY<u>KVSNRFS</u>GVPDR
FSGSGSGTDFTLKISRVEAEDVGVYYC<u>MQGSHVPRT</u>FGGGT
KVEIK (SEQ ID NO: 100)

HLA-B*07 antigen binding domains

BB7.1.10_scFv
QVQLQESGPGLVKPSQTLSLTCTVSGYSITSGYSWHWIRQPP
GKGLEWIGYIHFSGSTHYHPSLKSRVTISVDTSKNQFSLKLSS
VTAADTAVYYCARGGVVSHYAMDCWGQGTTVTVSSGGG
GSGGGGSGGGGSGGDIQMTQSPSSLSASVGDRVTITCRASE
NIYSNLAWYQQKPGKAPKLLIYAATYLPDGVPSRFSGSGSG
TDFTLTISSLQPEDFATYYCQHFWVTPYTFGGGTKVEIK
(SEQ ID NO: 199)

BB7.1.9_scFv
EVQLVESGGGLVKPGGSLRLSCAASGYSITSGYSWHWVRQ
APGKGLEWVSYIHFSGSTHYHPSLKSRFTISRDNAKNSLYLQ
MNSLRAEDTAVYYCARGGVVSHYAMDCWGQGTTVTVSSG
GGGSGGGGSGGGGSGGDIQMTQSPSSVSASVGDRVTITCRA
SENIYSNLAWYQQKPGKAPKLLIYAATYLPDGVPSRFSGSG
SGTDFTLTISSLQPEDFATYYCQHFWVTPYTFGGGTKVEIK
(SEQ ID NO: 200)

BB7.1.8_scFv
EVQLVESGGGLVKPGGSLRLSCAASGYSITSGYSWHWVRQ
APGKGLEWVGYIHFSGSTHYHPSLKSRFTISRDDSKNTLYLQ
MNSLKTEDTAVYYCARGGVVSHYAMDCWGQGTTVTVSSG
GGSGGGGSGGGGSGGEIVLTQSPATLSLSPGERATLSCRAS
ENIYSNLAWYQQKPGQAPRLLIYAATYLPDGIPARFSGSGSG
TDFTLTISSLEPEDFAVYYCQHFWVTPYTFGGGTKVEIK
(SEQ ID NO: 201)

TABLE 4-continued scFv binding domains

BB7.1.7_scFv QVQLQQSGPGLVKPSQTLSLTCAISGYSITSGYSWHWIRQSP
SRGLEWLGYIHFSGSTHYHPSLKSRITINPDTSKNQFSLQLNS
VTPEDTAVYYCARGGVVSHYAMDCWGQGTTVTVSSGGGG
SGGGGSGGGGSGGEIVLTQSPATLSLSPGERATLSCRASENI
YSNLAWYQQKPGQAPRLLIYAATYLPDGIPARFSGSGSGTD
FTLTISRLEPEDFAVYYCQHFWVTPYTFGGGTKVEIK(SEQ
IDNO:202)

BB7.1.6_scFv EVQLVESGGGLVKPGGSLRLSCAASGYSITSGYSWHWVRQ
APGKGLEWVGYIHFSGSTHYHPSLKSRFTISRDDSKNTLYLQ
MNSLKTEDTAVYYCARGGVVSHYAMDCWGQGTTVTVSSG
GGSGGGGSGGGGSGGDIQMTQSPSSVSASVGDRVTITCRA
SENIYSNLAWYQQKPGKAPKLLIYAATYLPDGVPSRFSGSG
SGTDFTLTISSLQPEDFATYYCQHFWVTPYTFGGGTKVEIK
(SEQ ID NO: 203)

BB7.1.5_scFv EVQLVESGGGLVQPGGSLRLSCAASGYSITSGYSWHWVRQ
APGKGLEWVSYIHFSGSTHYHPSLKSRFTISRDNSKNTLYLQ
MNSLRAEDTAVYYCARGGVVSHYAMDCWGQGTTVTVSSG
GGSGGGGSGGGGSGGDIQMTQSPSSLSASVGDRVTITCRA
SENIYSNLAWYQQKPGKAPKLLIYAATYLPDGVPSRFSGSG
SGTDFTLTISSLQPEDFATYYCQHFWVTPYTFGGGTKVEIK
(SEQ ID NO: 204)

BB7.1.4_scFv EVQLVESGGGLVKPGGSLRLSCAASGYSITSGYSWHWVRQ
APGKGLEWVGYIHFSGSTHYHPSLKSRFTISRDDSKNTLYLQ
MNSLKTEDTAVYYCARGGVVSHYAMDCWGQGTTVTVSSG
GGSGGGGSGGGGSGGDIQMTQSPSSLSASVGDRVTITCRA
SENTYSNLAWYQQKPGKAPKLLIYAATYLPDGVPSRFSGSG
SGTDFTLTISSLQPEDFATYYCQHFWVTPYTFGGGTKVEIK
(SEQ ID NO: 205)

BB7 1.3_scFv QVQLQQWGAGLLKPSETLSLTCAVYGYSITSGYSWHWIRQ
PPGKGLEWIGYIHFSGSTHYHPSLKSRVTISVDTSKNQFSLKL
SSVTAADTAVYYCARGGVVSHYAMDCWGQGTTVTVSSGGG
GGSGGGGSGGGGSGGDIQMTQSPSSLSASVGDRVTITCRAS
ENIYSNLAWYQQKPGKAPKLLIYAATYLPDGVPSRFSGSGS
GTDFTLTISSLQPEDFATYYCQHFWVTPYTFGGGTKVEIK
(SEQ ID NO: 206)

BB7.1.2_scFv QVQLQESGPGLVKPSQTLSLTCTVSGYSITSGYSWHWIRQH
PGKGLEWIGYIHFSGSTHYHPSLKSRVTISVDTSKNQFSLKLS
SVTAADTAVYYCARGGVVSHYAMDCWGQGTTVTVSSGGG
GSGGGGSGGGGSGGDIQMTQSPSSLSASVGDRVTITCRASE
NIYSNLAWYQQKPGKAPKLLIYAATYLPDGVPSRFSGSGSG
TDFTLTISSLQPEDFATYYCQHFWVTPYTFGGGTKVEIK
(SEQ ID NO: 207)

BB7.1.1_scFv QVQLQQSGPGLVKPSQTLSLTCAISGYSITSGYSWHWIRQSP
SRGLEWLGYIHFSGSTHYHPSLKSRITINPDTSKNQFSLQLNS
VTPEDTAVYYCARGGVVSHYAMDCWGQGTTVTVSSGGGG
SGGGGSGGGGSGGDIQMTQSPSSLSASVGDRVTITCRASENI
YSNLAWYQQKPGKAPKLLIYAATYLPDGVPSRFSGSGSGTD
FTLTISSLQPEDFATYYCQHFWVTPYTFGGGTKVEIK(SEQ
ID NO: 208)

HLA-A*11 antigen binding domains

9 QVQLQESGPGLVKPSQTLSLTCTVSGGSISSGGYYWSWIRQP
PGKGLEWIGYIYYSGSTYYNPSLKSRVTISVDTSKNQFSLKL
SSVTAADTAVYYCARHYYYYSMDVWGKGTTVTVSSGGGG
SGGGGSGGGGSGGDIQMTQSPSSLSASVGDRVTITCRASQSI
SSYLNWYQQKPGKAPKLLIYAASSLQSGVPSRFSGSGSGTD
FTLTISSLQPEDFATYYCQQSYSTPLTFGGGTKVEIK(SEQ ID
NO: 209)

8 QITLKESGPTLVKPTQTLTLTCTFSGFSLSTSGVGVGWIRQPP
GKALEWLALIYWNDDKRYSPSLKSRLTITKDTSKNQVVLT
MTNMDPVDTATYYCAHRHMRLSCFDYWGQGTLVTVSSGG
GSGGGGSGGGGSGGDIQMTQSPSSLSASVGDRVTITCRAS
QSISSYLNWYQQKPGKAPKLLIYAASSLQSGVPSRFSGSGSG
TDFTLTISSLQPEDFATYYCQQSYSTPLTFGGGTKVEIK(SEQ
ID NO: 210)

7 QVQLVQSGAEVKKPGASVKVSCKASGYTFTSYAMHWVRQ
APGQRLEWMGWINAGNGNTKYSQKFQGRVTITRDTSASTA
YMELSSLRSEDTAVYYCAREGNGANPDAFDIWGQGTMVTV
SSGGGGSGGGGSGGGGSGGDIQMTQSPSSLSASVGDRVTIT

TABLE 4-continued

| | scFv binding domains |
|---|---|
| | CRASQSISSYLNWYQQKPGKAPKLLIYAASSLQSGVPSRFSG<br>SGSGTDFTLTISSLQPEDFATYYCQQSYSTPLTFGGGTKVEIK<br>(SEQ ID NO: 211) |
| 6 | EVQLVESGGGLVQPGGSLRLSCAASGFTFSSYDMFIWVRQA<br>TGKGLEWVSAIGTAGDTYYPGSVKGRFT1SRENAKNSLYLQ<br>MNSLRAGDTAVYYCARDLPGSYWYFDLWGRGTLVTVSSG<br>GGGSGGGGSGGGGSGGDIQMTQSPSSLSASVGDRVTITCRA<br>SQSISSYLNWYQQKPGKAPKLLIYAASSLQSGVPSRFSGSGS<br>GTDFTLTISSLQPEDFATYYCQQSYSTPLTFGGGTKVEIK<br>(SEQ ID NO: 212) |
| 5 | QVQLQESGPGLVKPSQTLSLTCTVSGGSISSGGYYWSWIRQP<br>PGKGLEWIGYIYYSGSTYYNPSLKSRVTISVDTSKNQFSLKL<br>SSVTAADTAVYYCARHYYYYLDVWGKTTVTVSSGGGG<br>SGGGGSGGGGSGGDIQMTQSPSSLSASVGDRVTITCRASQSI<br>SSYLNWYQQKPGKAPKLLIYAASSLQSGVPSRFSGSGSGTD<br>FTLTISSLQPEDFATYYCQQSYSTPLTFGGGTKVEIK(SEQID<br>NO: 213) |
| 4 | EVQLVESGGGLVQPGGSLRLSCAASGFTFSSYWMHWVRQA<br>PGKGLVWVSRINSDGSSTSYADSVKGRFTISRDNAKNTLYL<br>QMNSLRAEDTAVYYCLGVLLYNWFDPWGQGTLVTVSSG<br>GGGSGGGGSGGGGSGGDIQMTQSPSSLSASVGDRVTITCRA<br>SQSISSYLNWYQQKPGKAPKLLIYAASSLQSGVPSRFSGSGS<br>GTDFTLTISSLQPEDFATYYCQQSYSTPLTFGGGTKVEIK<br>(SEQ ID NO: 214) |
| 3 | QVQLQESGPGLVKPSQTLSLTCTVSGGSISSGGYYWSWIRQP<br>PGKGLEWIGYIYYSGSTYYNPSLKSRVTISVDTSKNQFSLKL<br>SSVTAADTAVYYCARHYYYYMDVWGKGTTVTVSSGGGGS<br>GGGGSGGGGSGGDIQMTQSPSSLSASVGDRVTITCRASQSIS<br>SYLNWYQQKPGKAPKLLIYAASSLQSGVPSRFSGSGSGTDF<br>TLTISSLQPEDFATYYCQQSYSTPLTFGGGTKVEIK(SEQID<br>NO: 215) |
| 2 | QITLKESGPTLVKPTQTLTLTCTFSGFSLSTSGVGVGWIRQPP<br>GKALEWLALIYWNDDKRYSPSLKSRLTITKDTSKNQVVLT<br>MTNMDPVDTATYYCAHKTTSFYFDYWGQGTLVTVSSGGG<br>GSGGGGSGGGGSGGDIQMTQSPSSLSASVGDRVTITCRASQ<br>SISSYLNWYQQKPGKAPKLLIYAASSLQSGVPSRFSGSGSGT<br>DFTLTISSLQPEDFATYYCQQSYSTPLTFGGGTKVEIK(SEQ<br>IDNO: 216) |
| 1 | QVQLQESGPGLVKPSQTLSLTCTVSGGSISSGGYYWSWIRQP<br>PGKGLEWIGYIYYSGSTYYNPSLKSRVTISVDTSKNQFSLKL<br>SSVTAADTAVYYCARHYYYYMDVWGKGTTVTVSSGGG<br>GSGGGGSGGGGSGGDIQMTQSPSSLSASVGDRVTITCRASQ<br>SISSYLNWYQQKPGKAPKLLIYAASSLQSGVPSRFSGSGSGT<br>DFTLTISSLQPEDFATYYCQQSYSTPLTFGGGTKVEIK(SEQ<br>IDNO: 217) |
| | HLA-C*07 antisen binding domains |
| C7-45 | EVQLLESGGGLVQPGGSLRLSCAASGFTFSSYAMSWVRQAPGKGLEWVSAISGS<br>GGSTYYADSVKGRFTISRDNSKNTLYLQMNSLRAEDTAVYYCAVSFDWFDPWG<br>QGTLVTVSSGGGGSGGGGSGGGGSGGDIQMTQSPSSLSASVGDRVTITCRASQ<br>SISSYLNWYQQKPGKAPKLLIYAASSLQSGVPSRFSGSGSGTDFTLTISSLQP<br>EDFATYYCQQSYSTPLTFGGGTKVEIK (SEQ ID NO: 218) |
| C7-44 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARERSISPYYYYY<br>MDVWGKGTTVTVSSGGGGSGGGGSGGGGSGGDIQMTQSPSSLSASVGDRVTITCR<br>ASQSISSYLNWYQQKPGKAPKLLIYAASSLQSGVPSRFSGSGSGTDFTLTISSLQ<br>PEDFATYYCQQSYSTPLTFGGGTKVEIK (SEQ ID NO: 219) |
| C7-43 | QLQLQESGPGLVKPSETLSLTCTVSGGSISSSSYYWGWIRQPPGKGLEWIGSIYYS<br>GSTYYNPSLKSRVTISVDTSKNQFSLKLSSVTAADTAVYYCARDSVIWYWFDPWG<br>QGTLVTVSSGGGGSGGGGSGGGGSGGQSVLTQPPSASGTPGQRVTISCSGSSSN<br>IGSNTVNWYQQLPGTAPKLLIYSNNQRPSGVPDRFSGSKSGTSASLAISGLQSEDE<br>ADYYCAAWDDSLNGWVFGGGTKLTVL (SEQ ID NO: 220) |
| C7-42 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCAREEILPRLSYYYY<br>MDVWGKGTTVTVSSGGGGSGGGGSGGGGSGGDIQMTQSPSSLSASVGDRVTITCR<br>ASQSISSYLNWYQQKPGKAPKLLIYAASSLQSGVPSRFSGSGSGTDFTLTISSLQ<br>PEDFATYYCQQSYSTPLTFGGGTKVEIK (SEQ ID NO: 221) |

TABLE 4-continued

| scFv binding domains | |
|---|---|
| C7-41 | QVQLVQSGSELKKPGASVKVSCKASGYTFTSYAMNWVRQAPGQGLEWMGWINT<br>NTGNPTYAQGFTGRFVFSFDTSVSTAYLQICSLKAEDTAVYYCARGGRAHSSW<br>YFDLWGRGTLVTVSSGGGGSGGGGSGGGGSGGDIQMTQSPSSLSASVGDRVTI<br>TCRASQSISSYLNWYQQKPGKAPKLLIYAASSLQSGVPSRFSGSGSGTDFTLTI<br>SSLQPEDFATYYCQQSYSTPLTFGGGTKVEIK (SEQ ID NO: 222) |
| C7-40 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDRIKILPRLGYY<br>YYMDVWGKGTTVTVSSGGGGSGGGGSGGGGSGGDIQMTQSPSSLSASVGDRVTITC<br>RASQSISSYLNWYQQKPGKAPKLLIYAASSLQSGVPSRFSGSGSGTDFTLTISSL<br>QPEDFATYYCQQSYSTPLTFGGGTKVEIK (SEQ ID NO: 223) |
| C7-39 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDTVIHYYYYMDV<br>WGKGTTVTVSSGGGGSGGGGSGGGGSGGDIQMTQSPSSLSASVGDRVTITCRASQ<br>SISSYLNWYQQKPGKAPKLLIYAASSLQSGVPSRFSGSGSGTDFTLTISSLQPED<br>FATYYCQQSYSTPLTFGGGTKVEIK (SEQ ID NO: 224) |
| C7-38 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDVIVEVFLSYY<br>YYMDVWGKGTTVTVSSGGGGSGGGGSGGGGSGGDIQMTQSPSSLSASVGDRVTI<br>TCRASQSISSYLNWYQQKPGKAPKLLIYAASSLQSGVPSRFSGSGSGTDFTLTIS<br>SLQPEDFATYYCQQSYSTPLTFGGGTKVEIK (SEQ ID NO: 225) |
| C7-37 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDIFIHYYYYMD<br>VWGKGTTVTVSSGGGGSGGGGSGGGGSGGDIQMTQSPSSLSASVGDRVTITCRAS<br>QSISSYLNWYQQKPGKAPKLLIYAASSLQSGVPSRFSGSGSGTDFTLTISSLQPE<br>DFATYYCQQSYSTPLTFGGGTKVEIK (SEQ ID NO: 226) |
| C7-36 | EVQLVESGGGLVQPGGSLRLSCAASGFTFSSYSMNWVRQAPGKGLEWVSYISSS<br>SSTIYYADSVKGRFTISRDNAKNSLYLQMNSLRAEDTAVYYCARDGTFYSYSPYYF<br>DYWGQGTLVTVSSGGGGSGGGGSGGGGSGGDIQMTQSPSSLSASVGDRVTITC<br>RASQSISSYLNWYQQKPGKAPKLLIYAASSLQSGVPSRFSGSGSGTDFTLTISSLQP<br>EDFATYYCQQSYSTPLTFGGGTKVEIK (SEQ ID NO: 227) |
| C7-35 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCAREWIKILPRLGYYYY<br>MDVWGKGTTVTVSSGGGGSGGGGSGGGGSGGDIQMTQSPSSLSASVGDRVTI<br>TCRASQSISSYLNWYQQKPGKAPKLLIYAASSLQSGVPSRFSGSGSGTDFTLTISSL<br>QPEDFATYYCQQSYSTPLTFGGGTKVEIK (SEQ ID NO: 228) |
| C7-34 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDRSLYYYYYMDV<br>WGKGTTVTVSSGGGGSGGGGSGGGGSGGDIQMTQSPSSLSASVGDRVTITCRA<br>SQSISSYLNWYQQKPGKAPKLLIYAASSLQSGVPSRFSGSGSGTDFTLTISSLQPED<br>FATYYCQQSYSTPLTFGGGTKVEIK (SEQ ID NO: 229) |
| C7-33 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARDKILAPNYYYYMD<br>VWGKGTTVTVSSGGGGSGGGGSGGGGSGGDIQMTQSPSSLSASVGDRVTITCR<br>ASQSISSYLNWYQQKPGKAPKLLIYAASSLQSGVPSRFSGSGSGTDFTLTISSLQPE<br>DFATYYCQQSYSTPLTFGGGTKVEIK (SEQ ID NO: 230) |
| C7-32 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCAREKSWKYFYYYYYY<br>MDVWGKGTTVTVSSGGGGSGGGGSGGGGSGGDIQMTQSPSSLSASVGDRVTI<br>TCRASQSISSYLNWYQQKPGKAPKLLIYAASSLQSGVPSRFSGSGSGTDFTLTISSL<br>QPEDFATYYCQQSYSTPLTFGGGTKVEIK (SEQ ID NO: 231) |
| C7-31 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCARENTSTIPYYYYM<br>DVWGKGTTVTVSSGGGGSGGGGSGGGGSGGDIQMTQSPSSLSASVGDRVTITC<br>RASQSISSYLNWYQQKPGKAPKLLIYAASSLQSGVPSRFSGSGSGTDFTLTISSLQP<br>EDFATYYCQQSYSTPLTFGGGTKVEIK (SEQ ID NO: 232) |
| C7-30 | QVQLQESGPGLVKPSQTLSLTCTVSGGSISSGGYYWSWIRQPPGKGLEWIGYIYY<br>SGSTYYNPSLKSRVTISVDTSKNQFSLKLSSVTAADTAVYYCAREDVDKNTSTIYYY<br>YYYMDVWGKGTTVTVSSGGGGSGGGGSGGGGSGGDIQMTQSPSSLSASVGDR<br>VTITCRASQSISSYLNWYQQKPGKAPKLLIYAASSLQSGVPSRFSGSGSGTDFTLTIS<br>SLQPEDFATYYCQQSYSTPLTFGGGTKVEIK (SEQ ID NO: 233) |
| C7-29 | QVQLVESGGGLVKPGGSLRLSCAASGFTFSDYYMSWIRQAPGKGLEWVSYISSS<br>GSTIYYADSVKGRFTISRDNAKNSLYLQMNSLRAEDTAVYYCARDGGDIVSSSAIY<br>WYFDLWGRGTLVTVSSGGGGSGGGGSGGGGSGGAIQLTQSPSSLSASVGDRVT<br>ITCRASQGISSALAWYQQKPGKAPKLLIYDASSLESGVPSRFSGSGSGTDFTLTISSL<br>QPEDFATYYCQQFNSYPLTFGGGTKVEIK (SEQ ID NO: 234) |

TABLE 4-continued scFv binding domains

C7-28    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARDLILPPYYYYMD
         VWGKGTTVTVSSGGGGSGGGGSGGGGSGGDIQMTQSPSSLSASVGDRVTITCR
         ASQSISSYLNWYQQKPGKAPKLLIYAASSLQSGVPSRFSGSGSGTDFTLTISSLQPE
         DFATYYCQQSYSTPLTFGGGTKVEIK (SEQ ID NO: 235)

C7-27    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARETWIKILPRYYYYY
         YYMDVWGKGTTVTVSSGGGGSGGGGSGGGGSGGDIQMTQSPSSLSASVGDR
         VTITCRASQSISSYLNWYQQKPGKAPKLLIYAASSLQSGVPSRFSGSGSGTDFTLTIS
         SLQPEDFATYYCQQSYSTPLTFGGGTKVEIK (SEQ ID NO: 236)

C7-26    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARDLSRYYYYYMDV
         WGKGTTVTVSSGGGGSGGGGSGGGGSGGDIQMTQSPSSLSASVGDRVTITCRA
         SQSISSYLNWYQQKPGKAPKLLIYAASSLQSGVPSRFSGSGSGTDFTLTISSLQPED
         FATYYCQQSYSTPLTFGGGTKVEIK (SEQ ID NO: 237)

C7-25    EVQLVESGGGLVQPGGSLRLSCAASGFTFSSYSMNWVRQAPGKGLEWVSYISSS
         SSTIYYADSVKGRFTISRDNAKNSLYLQMNSLRAEDTAVYYCAREHIVLCFDYWG
         QGTLVTVSSGGGGSGGGGSGGGGSGGDIQMTQSPSSLSASVGDRVTITCRASQ
         GISSWLAWYQQKPEKAPKSLIYAASSLQSGVPSRFSGSGSGTDFTLTISSLQPEDFA
         TYYCQQYNSYPLTFGGGTKVEIK (SEQ ID NO: 238)

C7-24    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARDKILPRPYYYYYM
         DVWGKGTTVTVSSGGGGSGGGGSGGGGSGGDIQMTQSPSSLSASVGDRVTITC
         RASQSISSYLNWYQQKPGKAPKLLIYAASSLQSGVPSRFSGSGSGTDFTLTISSLQP
         EDFATYYCQQSYSTPLTFGGGTKVEIK (SEQ ID NO: 239)

C7-23    QVQLVQSGAEVKKPGASVKVSCKASGYTFTSYGISWVRQAPGQGLEWMGWIS
         AYNGNTNYAQKLQGRVTMTTDTSTSTAYMELRSLRSDDTAVYYCARGSNEYFQ
         HWGQGTLVTVSSGGGGSGGGGSGGGGSGGQSALTQPPSASGSPGQSVTISCT
         GTSSDVGGYNYVSWYQQHPGKAPKLMIYEVSKRPSGVPDRFSGSKSGNTASLTV
         SGLQAEDEADYYCSSYAGSNNWVFGGGTKLTVL (SEQ ID NO: 240)

C7-22    QVQLVQSGSELKKPGASVKVSCKASGYTFTSYAMNWVRQAPGQGLEWMGWI
         NTNTGNPTYAQGFTGRFVFSFDTSVSTAYLQICSLKAEDTAVYYCARGTSYWYFD
         LWGRGTLVTVSSGGGGSGGGGSGGGGSGGDIQMTQSPSSLSASVGDRVTITCR
         ASQSISSYLNWYQQKPGKAPKLLIYAASSLQSGVPSRFSGSGSGTDFTLTISSLQPE
         DFATYYCQQSYSTPLTFGGGTKVEIK (SEQ ID NO: 241)

C7-21    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCAREEIVEVFYYYYMD
         VWGKGTTVTVSSGGGGSGGGGSGGGGSGGDIQMTQSPSSLSASVGDRVTITCR
         ASQSISSYLNWYQQKPGKAPKLLIYAASSLQSGVPSRFSGSGSGTDFTLTISSLQPE
         DFATYYCQQSYSTPLTFGGGTKVEIK (SEQ ID NO: 242)

C7-20    EVQLLESGGGLVQPGGSLRLSCAASGFTFSSYAMSWVRQAPGKGLEWVSAISGS
         GGSTYYADSVKGRFTISRDNSKNTLYLQMNSLRAEDTAVYYCAKVDDYYFDYWG
         QGTLVTVSSGGGGSGGGGSGGGGSGGDIQMTQSPSSLSASVGDRVTITCRASQ
         SISSYLNWYQQKPGKAPKLLIYAASSLQSGVPSRFSGSGSGTDFTLTISSLQPEDFA
         TYYCQQSYSTPLTFGGGTKVEIK (SEQ ID NO: 243)

C7-19    EVQLVESGGGLVQPGGSLRLSCAASGFTFSSYWMHWVRQAPGKGLVWVSRINS
         DGSSTSYADSVKGRFTISRDNAKNTLYLQMNSLRAEDTAVYYCAWSTNILLSYTKA
         FDIWGQGTMVTVSSGGGGSGGGGSGGGGSGGDIQMTQSPSSLSASVGDRVTI
         TCRASQSISSYLNWYQQKPGKAPKLLIYAASSLQSGVPSRFSGSGSGTDFTLTISSL
         QPEDFATYYCQQSYSTPLTFGGGTKVEIK (SEQ ID NO: 244)

C7-18    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARDKTYYYYYYMDV
         WGKGTTVTVSSGGGGSGGGGSGGGGSGGDIQMTQSPSSLSASVGDRVTITCRA
         SQSISSYLNWYQQKPGKAPKLLIYAASSLQSGVPSRFSGSGSGTDFTLTISSLQPED
         FATYYCQQSYSTPLTFGGGTKVEIK (SEQ ID NO: 245)

C7-17    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCAREKYFHDKYFHDYY
         YYYMDVWGKGTTVTVSSGGGGSGGGGSGGGGSGGDIQMTQSPSSLSASVGDR
         VTITCRASQSISSYLNWYQQKPGKAPKLLIYAASSLQSGVPSRFSGSGSGTDFTLTIS
         SLQPEDFATYYCQQSYSTPLTFGGGTKVEIK (SEQ ID NO: 246)

C7-16    QVQLQESGPGLVKPSQTLSLTCTVSGGSISSGGYYWSWIRQPPGKGLEWIGYIYY
         SGSTYYNPSLKSRVTISVDTSKNQFSLKLSSVTAADTAVYYCARDTSVYYYYYMDV
         WGKGTTVTVSSGGGGSGGGGSGGGGSGGDIQMTQSPSSLSASVGDRVTITCRA
         SQSISSYLNWYQQKPGKAPKLLIYAASSLQSGVPSRFSGSGSGTDFTLTISSLQPED
         FATYYCQQSYSTPLTFGGGTKVEIK (SEQ ID NO: 247)

TABLE 4-continued

| scFv binding domains | |
|---|---|
| C7-15 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCAREKILPYYYYYMD VWGKGTTVTVSSGGGGSGGGGSGGGGSGGDIQMTQSPSSLSASVGDRVTITCR ASQSISSYLNWYQQKPGKAPKLLIYAASSLQSGVPSRFSGSGSGTDFTLTISSLQPE DFATYYCQQSYSTPLTFGGGTKVEIK (SEQ ID NO: 248) |
| C7-14 | EVQLVESGGGLVQPGGSLRLSCAASGFTFSSYSMNWVRQAPGKGLEWVSYISSS SSTIYYADSVKGRFTISRDNAKNSLYLQMNSLRAEDTAVYYCAIQWIYIYINPRG FIFLHDAFDIWGQGTMVTVSSGGGGSGGGGSGGGGSGGQSVLTQPPSASGTPGQ RVTISCSGSSSNIGSNTVNWYQQLPGTAPKLLIYSNNQRPSGVPDRFSGSKSGTSA SLAISGLQSEDEADYYCAAWDDSLNGWVFGGGTKLTVL (SEQ ID NO: 249) |
| C7-13 | QVQLQQSGPGLVKPSQTLSLTCAISGDSVSSNSAAWNWlRQSPSRGLEWLGRTY YRSKWYNDYAVSVKSRITINPDTSKNQFSLQLNSVTPEDTAVYYCAKEDVDFHHD AFDIWGQGTMVTVSSGGGGSGGGGSGGGGSGGDIQMTQSPSSLSASVGDRVTITC RASQSISSYLNWYQQKPGKAPKLLIYAASSLQSGVPSRFSGSGSGTDFTLTISSL QPEDFATYYCQQSYSTPLTFGGGTKVEIK (SEQ ID NO: 250) |
| C7-12 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCAREGVDKNTSTIYYY YYYMDVWGKGTTVTVSSGGGGSGGGGSGGGGSGGDIQMTQSPSSLSASVGDRVTI TCRASQSISSYLNWYQQKPGKAPKLLIYAASSLQSGVPSRFSGSGSGTDFTLTIS SLQPEDFATYYCQQSYSTPLTFGGGTKVEIK (SEQ ID NO: 251) |
| C7-11 | EVQLVESGGGLVQPGGSLRLSCAASGFTFSSYSMNWVRQAPGKGLEWVSYISSS SSTIYYADSVKGRFTISRDNAKNSLYLQMNSLRAEDTAVYYCARDRRGYFDLWGR GTLVTVSSGGGGSGGGGSGGGGSGGDIQMTQSPSSLSASVGDRVTITCRASQGI SSWLAWYQQKPEKAPKSLIYAASSLQSGVPSRFSGSGSGTDFTLTISSLQPEDFAT YYCQQYNSYPLTFGGGTKVEIK (SEQ ID NO: 252) |
| C7-10 | EVQLVQSGAEVKKPGATVKISCKVSGYTFTDYYMHWVQQAPGKGLEWMGLVDPE DGETIYAEKFQGRVTITADTSTDTAYMELSSLRSEDTAVYYCATGIHVDIRSME DWFDPWGQGTLVTVSSGGGGSGGGGSGGGGSGGDIQMTQSPSSLSASVGDRVTIT CRASQSISSYLNWYQQKPGKAPKLLIYAASSLQSGVPSRFSGSGSGTDFTLTIS SLQPEDFATYYCQQSYSTPLTFGGGTKVEIK (SEQ ID NO: 253) |
| C7-9 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCARDIGTSYYYYMDV WGKGTTVTVSSGGGGSGGGGSGGGGSGGDIQMTQSPSSLSASVGDRVTITCRASQS ISSYLNWYQQKPGKAPKLLIYAASSLQSGVPSRFSGSGSGTDFTLTISSLQPED FATYYCQQSYSTPLTFGGGTKVEIK (SEQ ID NO: 254) |
| C7-8 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCAREVVEVFLYYYYYM DVWGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQP EDFATYYCQQSYSTPLTFGGGTKVEIK (SEQ ID NO: 255) |
| C7-7 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCARDLYYYYYYYMDV WGKGTTVTVSSGGGGSGGGGSGGGGSGGDIQMTQSPSSLSASVGDRVTITCRASQ SISSYLNWYQQKPGKAPKLLIYAASSLQSGVPSRFSGSGSGTDFTLTISSLQPED FATYYCQQSYSTPLTFGGGTKVEIK (SEQ ID NO: 256) |
| C7-6 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCARESWKYFYPRGSI FIHYYYMDVWGKGTTVTVSSGGGGSGGGGSGGGGSGGDIQMTQSPSSLSASVGD RVTITCRASQSISSYLNWYQQKPGKAPKLLIYAASSLQSGVPSRFSGSGSGTDFTL TISSLQPEDFATYYCQQSYSTPLTFGGGTKVEIK (SEQ ID NO: 257) |
| C7-5 | QVQLQESGPGLVKPSQTLSLTCTVSGGSISSGGYYWSWIRQPPGKGLEWIGYIYYS GSTYYNPSLKSRVTISVDTSKNQFSLKLSSVTAADTAVYYCARDRIVEVFYYYYMD VWGKGTTVTVSSGGGGSGGGGSGGGGSGGDIQMTQSPSSLSASVGDRVTITCRAS QSISSYLNWYQQKPGKAPKLLIYAASSLQSGVPSRFSGSGSGTDFTLTISSLQPE DFATYYCQQSYSTPLTFGGGTKVEIK (SEQ ID NO: 258) |
| C7-4 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCAREKYFHDWLYYY MYYDVWGKGTTVTVSSGGGGSGGGGSGGGGSGGDIQMTQSPSSLSASVGDRVTIT CRASQSISSYLNWYQQKPGKAPKLLIYAASSLQSGVPSRFSGSGSGTDFTLTISS LQPEDFATYYCQQSYSTPLTFGGGTKVEIK (SEQ ID NO: 259) |
| C7-3 | QVQLQESGPGLVKPSQTLSLTCTVSGGSISSGGYYWSWIRQPPGKGLEWIGYIYY SGSTYYNPSLKSRVTISVDTSKNQFSLKLSSVTAADTAVYYCARDLVDKNTSYYY MYYDVWGKGTTVTVSSGGGGSGGGGSGGGGSGGDIQMTQSPSSLSASVGDRVTI TCRASQSISSYLNWYQQKPGKAPKLLIYAASSLQSGVPSRFSGSGSGTDFTLTI SSLQPEDFATYYCQQSYSTPLTFGGGTKVEIK (SEQ ID NO: 260) |

TABLE 4-continued

| | scFv binding domains |
|---|---|
| C7-2 | QVQLVQSGAEVKKPGASVKVSCKASGYTFTSYGISWVRQAPGQGLEWMGWIS AYNGNTNYAQKLQGRVTMTTDTSTSTAYMELRSLRSDDTAVYYCARVQNEYFQ HWGQGTLVTVSSGGGGSGGGGSGGGGSGGQSALTQPPSASGSPGQSVTISCT GTSSDVGGYNYVSWYQQHPGKAPKLMIYEVSKRPSGVPDRFSGSKSGNTASLTV SGLQAEDEADYYCSSYAGSNNWVFGGGTKLTVL (SEQ ID NO: 261) |
| C7-1 | QVQLVESGGGLVKPGGSLRLSCAASGFTFSDYYMSWIRQAPGKGLEWVSYISSS GSTIYYADSVKGRFTISRDNAKNSLYLQMNSLRAEDTAVYYCATANWFDPWGQ GTLVTVSSGGGGSGGGGSGGGGSGGDIQMTQSPSSVSASVGDRVTITCRASQGI SSWLAWYQQKPGKAPKLLIYAASSLQSGVPSRFSGSGSGTDFTLTISSLQPEDF ATYYCQQANSFPLTFGGGTKVEIK (SEQ ID NO: 262) |
| | HLA-A*03 scFv Sequences |
| 15 | QVQLVQSGAEVKKPGASVKVSCKASGYTFTSYGISWVRQA PGQGLEWMGWISAYNGNTNYAQKLQGRVTMTTDTSTSTA YMELRSLRSDDTAVYYCARERVSQRGAFDIWGQGTMVTVS SGGGGSGGGGSGGGGSGGDIQMTQSPSSLSASVGDRVTITC RASQSISSYLNWYQQKPGKAPKLLIYAASSLQSGVPSRFSGS GSGTDFTLTISSLQPEDFATYYCQQSYSTPLTFGGGTKVEIK (SEQ ID NO: 263) |
| 16 | EVQLVESGGGLVQPGGSLRLSCAASGFTFSSYSMNWVRQA PGKGLEWVSYISSSSSTIYYADSVKGRFTISRDNAKNSLYLQ MNSLRAEDTAVYYCARGNPDKDPFDYWGQGTLVTVSSGG GGSGGGGSGGGGSGGDIQMTQSPSSLSASVGDRVTITCRAS QSISSYLNWYQQKPGKAPKLLIYAASSLQSGVPSRFSGSGSG TDFTLTISSLQPEDFATYYCQQSYSTPLTFGGGTKVEIK(SEQ IDNO: 264) |
| 17 | QVQLQESGPGLVKPSETLSLTCTVSGGSVSSGSYYWSWIRQ PPGKGLEWIGYIYYSGSTNYNPSLKSRVTISVDTSKNQFSLK LSSVTAADTAVYYCARDFYCTNWYFDLWGRGTLVTVSSG GGGSGGGGSGGGGSGGDIQMTQSPSSLSASVGDRVTITCRA SQSISSYLNWYQQKPGKAPKLLIYAASSLQSGVPSRFSGSGS GTDFTLTISSLQPEDFATYYCQQSYSTPLTFGGGTKVEIK (SEQ ID NO: 265) |
| 18 | QVQLQESGPGLVKPSETLSLTCTVSGGSISSYYWSWIRQPPG KGLEWIGYIYYSGSTNYNPSLKSRVTISVDTSKNQFSLKLSS VTAADTAVYYCARESSSGSYWYFDLWGRGTLVTVSSGGG GSGGGGSGGGGSGGDIQMTQSPSSLSASVGDRVTITCRASQ SISSYLNWYQQKPGKAPKLLIYAASSLQSGVPSRFSGSGSGT DFTLTISSLQPEDFATYYCQQSYSTPLTFGGGTKVEIK(SEQ IDNO:266) |
| 19 | EVQLVQSGAEVKKPGESLKISCKGSGYSFTSYWIGWVRQMP GKGLEWMGIIYPGDSDTRYSPSFQGQVTISADKSISTAYLQW SSLKASDTAMYYCARDSGYKYNLYYYYYMDVWGKGTT VTVSSGGGGSGGGGSGGGGSGGDIQMTQSPSSLSASVGDRV TITCRASQSISSYLNWYQQKPGKAPKLLIYAASSLQSGVPSR FSGSGSGTDFTLTISSLQPEDFATYYCQQSYSTPLTFGGGTK VEIK (SEQ ID NO: 267) |
| 20 | QVQLVQSGAEVKKPGASVKVSCKASGYTFTSYGISWVRQA PGQGLEWMGWISAYNGNTNYAQKLQGRVTMTTDTSTSTA YMELRSLRSDDTAVYYCARGGDLSHYYYYMDVWGKGTT VTVSSGGGGSGGGGSGGGGSGGQTVVTQEPSLTVSPGGTV TLTCASSTGAVTSGYYPNWFQQKPGQAPRALIYSTNKHSW TPARFSGSLLGGKAALTLSGVQPEDEAEYYCLLYYGGAQW VFGGGTKLTVL (SEQ ID NO: 268) |
| 21 | QVQLVQSGAEVKKPGASVKVSCKASGYTFTSYGISWVRQA PGQGLEWMGWISAYNGNTNYAQKLQGRVTMTTDTSTSTA YMELRSLRSDDTAVYYCARENRRYNSCYYFDYWGQGTLV TVSSGGGGSGGGGSGGGGSGGDIQMTQSPSSLSASVGDRVT ITCRASQSISSYLNWYQQKPGKAPKLLIYAASSLQSGVPSRF SGSGSGTDFTLTISSLQPEDFATYYCQQSYSTPLTFGGGTKV EIK (SEQ ID NO: 269) |
| 22 | QVQLVQSGAEVKKPGASVKVSCKASGYTFTSYGISWVRQA PGQGLEWMGWISAYNGNTNYAQKLQGRVTMTTDTSTSTA YMELRSLRSDDTAVYYCARGGDLSHYYYYLDVWGKGTTV TVSSGGGGSGGGGSGGGGSGGQTVVTQEPSLTVSPGGTVTL TCASSTGAVTSGYYPNWFQQKPGQAPRALIYSTNKHSWTP ARFSGSLLGGKAALTLSGVQPEDEAEYYCLLYYGGAQWVF GGGTKLTVL (SEQ ID NO: 270) |

TABLE 4-continued scFv binding domains

| | |
|---|---|
| 23 | EVQLVESGGGLVQPGGSLRLSCAASGFTVSSNYMSWVRQA
PGKGLEWVSVIYSGGSTYYADSVKGRFTISRDNSKNTLYLQ
MNSLRAEDTAVYYCARATLLSLSYDAFDIWGQGTMVTVSS
GGGGSGGGGSGGGGSGGDIQMTQSPSSLSASVGDRVTITCR
ASQSISSYLNWYQQKPGKAPKLLIYAASSLQSGVPSRFSGSG
SGTDFTLTISSLQPEDFATYYCQQSYSTPLTFGGGTKVEIK
(SEQ ID NO: 271) |
| 24 | QVQLVQSGAEVKKPGASVKVSCKASGYTFTSYGISWVRQA
PGQGLEWMGWISAYNGNTNYAQKLQGRVTMTTDTSTSTA
YMELRSLRSDDTAVYYCARGGDLSHYYYMDVWGKGTTVT
VSSGGGGSGGGGSGGGGSGGQTVVTQEPSLTVSPGGTVTLT
CASSTGAVTSGYYPNWFQQKPGQAPRALIYSTSNKHSWTPA
RFSGSLLGGKAALTLSGVQPEDEAEYYCLLYYGGAQWVFG
GGTKLTVL (SEQ ID NO: 272) |
| 25 | EVQLVQSGAEVKKPGESLKISCKGSGYSFTSYWIGWVRQMP
GKGLEWMGIIYPGDSDTRYSPSFQGQVTISADKSISTAYLQW
SSLKASDTAMYYCARERDRWFDPWGQGTLVTVSSGGGGS
GGGGSGGGGSGGDIQMTQSPSSLSASVGDRVTITCRASQSIS
SYLNWYQQKPGKAPKLLIYAASSLQSGVPSRFSGSGSGTDF
TLTISSLQPEDFATYYCQQSYSTPLTFGGGTKVEIK (SEQID
NO: 273) |
| 26 | QVQLVQSGAEVKKPGASVKVSCKASGYTFTSYGISWVRQA
PGQGLEWMGWISAYNGNTNYAQKLQGRVTMTTDTSTSTA
YMELRSLRSDDTAVYYCARETPPSLGAFDIWGQGTMVTVS
SGGGGSGGGGSGGGGSGGQSALTQPPSASGSPGQSVTISCT
GTSSDVGGYNYVSWYQQHPGKAPKLMIYEVSKRPSGVPDR
FSGSKSGNTASLTVSGLQAEDEADYYCSSYAGSNNWVFGG
GTKLTVL (SEQ ID NO: 274) |
| 27 | QLQLQESGPGLVKPSETLSLTCTVSGGSISSSSYYWGWIRQP
PGKGLEWIGSIYYSGSTYYNPSLKSRVTISVDTSKNQFSLKLS
SVTAADTAVYYCAREAYCLSDSYWYFDLWGRGTLVTVSS
GGGGSGGGGSGGGGSGGQSVLTQPPSASGTPGQRVTISCSG
SSSNIGSNTVNWYQQLPGTAPKLLIYSNNQRPSGVPDRFSGS
KSGTSASLAISGLQSEDEADYYCAAWDDSLNGWVFGGGTK
LTVL (SEQ ID NO: 275) |
| 28 | QVQLQESGPGLVKPSQTLSLTCTVSGGSISSGGYYWSWIRQP
PGKGLEWIGYIYYSGSTYYNPSLKSRVTISVDTSKNQFSLKL
SSVTAADTAVYYCARESWKYFYPRGYMDVWGKGTTVTVS
SGGGGSGGGGSGGGGSGGDIQMTQSPSSLSASVGDRVTITC
RASQSISSYLNWYQQKPGKAPKLLIYAASSLQSGVPSRFSGS
GSGTDFTLTISSLQPEDFATYYCQQSYSTPLTFGGGTKVEIK
(SEQ ID NO: 276) |
| HLA-A*01 scFv Sequences | |
| A1-9 | QVQLVQSGAEVKKPGASVKVSCKASGYTFTSYGISWVRQA
PGQGLEWMGWISAYNGNTNYAQKLQGRVTMTTDTSTSTA
YMELRSLRSDDTAVYYCARGGWTAWYYYMDVWGKGTTV
TVSSGGGGSGGGGSGGGGSGGQTVVTQEPSLTVSPGGTVTL
TCASSTGAVTSGYYPNWFQQKPGQAPRALIYSTSNKHSWTP
ARFSGSLLGGKAALTLSGVQPEDEAEYYCLLYYGGAQWVF
GGGTKLTVL (SEQ ID NO: 277) |
| A1-8 | EVQLVESGGGLVQPGGSLRLSCAASGFTSSYSMNWVRQA
PGKGLEWVSYISSSSTIYYADSVKGRFTISRDNAKNSLYLQ
MNSLRAEDTAVYYCARAKYYYMDVWGKGTTVTVSSGGG
GSGGGGSGGGGSGGQSVLTQPPSASGTPGQRVTISCSGSSSN
IGSNTVNWYQQLPGTAPKLLIYSNNQRPSGVPDRFSGSKSGT
SASLAISGLQSEDEADYYCAAWDDSLNGWVFGGGTKLTVL
(SEQ ID NO: 278) |
| A1-7 | QVQLQESGPGLVKPSQTLSLTCTVSGGSISSGGYYWSWIRQP
PGKGLEWIGYIYYSGSTYYNPSLKSRVTISVDTSKNQFSLKL
SSVTAADTAVYYCARDQVDKNTYYYYMDVWGKGTTVTV
SSGGGGSGGGGSGGGGSGGDIQMTQSPSSLSASVGDRVTIT
CRASQSISSYLNWYQQKPGKAPKLLIYAASSLQSGVPSRFSG
SGSGTDFTLTISSLQPEDFATYYCQQSYSTPLTFGGGTKVEIK
(SEQ ID NO: 279) |

TABLE 4-continued scFv binding domains

A1-6  QVQLVESGGGLVKPGGSLRLSCAASGFTFSDYYMSWIRQAP
GKGLEWVSYISSSGSTIYYADSVKGRFTISRDNAKNSLYLQ
MNSLRAEDTAVYYCARACQLAEYFQHWGQGTLVTVSSGG
GGSGGGGSGGGGSGGDIQMTQSPSSVSASVGDRVTITCRAS
QGISSWLAWYQQKPGKAPKLLIYAASSLQSGVPSRFSGSGS
GTDFTLTISSLQPEDFATYYCQQANSFPLTFGGGTKVEIK
(SEQ ID NO: 280)

A1-5  QVQLQESGPGLVKPSQTLSLTCTVSGGSISSGGYYWSWIRQP
PGKGLEWIGYIYYSGSTYYNPSLKSRVTISVDTSKNQFSLKL
SSVTAADTAVYYCARDRVDKNTSYYYMDVWGKGTTVTVS
SGGGGSGGGGSGGGGSGGDIQMTQSPSSLSASVGDRVTITC
RASQSISSYLNWYQQKPGKAPKLLIYAASSLQSGVPSRFSGS
GSGTDFTLTISSLQPEDFATYYCQQSYSTPLTFGGGTKVEIK
(SEQ ID NO: 281)

A1-4  QVQLQESGPGLVKPSDTLSLTCAVSGYSISSSNWWGWIRQP
PGKGLEWIGYIYYSGSTYYNPSLKSRVTMSVDTSKNQFSLK
LSSVTAVDTAVYYCARRVQLKLVHWFDPWGQGTLVTVSS
GGGGSGGGGSGGGGSGGDIQMTQSPSSLSASVGDRVTITCR
ASQSISSYLNWYQQKPGKAPKLLIYAASSLQSGVPSRFSGSG
SGTDFTLTISSLQPEDFATYYCQQSYSTPLTFGGGTKVEIK
(SEQ ID NO: 282)

A1-3  QVQLVQSGAEVKKPGASVKVSCKASGYTFTSYDINWVRQA
TGQGLEWMGWMNPNSGNTGYAQKFQGRVTMTRNTSISTA
YMELSSLRSEDTAVYYCATYYDYVTVFYFQHWGQGTLVT
VSSGGGGSGGGGSGGGGSGGDIQMTQSPSSLSASVGDRVTI
TCRASQSISSYLNWYQQKPGKAPKLLIYAASSLQSGVPSRFS
GSGSGTDFTLTISSLQPEDFATYYCQQSYSTPLTFGGGTKVEI
K (SEQ ID NO: 283)

A1-2  QLQLQESGSGLVKPSQTLSLTCAVSGGSISSGGYSWSWIRQP
PGKGLEWIGYIYHSGSTYYNPSLKSRVTISVDRSKNQFSLKL
SSVTAADTAVYYCARESYPSFYAFDIWGQGTMVTVSSGGG
GSGGGGSGGGGSGGDIQMTQSPSSLSASVGDRVTITCRASQ
SISSYLNWYQQKPGKAPKLLIYAASSLQSGVPSRFSGSGSGT
DFTLTISSLQPEDFATYYCQQSYSTPLTFGGGTKVEIK(SEQ
IDNO: 284)

A1-1  QITLKESGPTLVKPTQTLTLTCTFSGFSLSTSGVGVGWIRQ
PPGKALEWLALIYWNDDKRYSPSLKSRLTITKDTSKNQVVL
TMTNMDPVDTATYYCAHSNMWSYSLNDYYFDYWGQGTLV
TVSSGGGGSGGGGSGGGGSGGDIQMTQSPSSLSASVGDRVT
ITCRASQSISSYLNWYQQKPGKAPKLLIYAASSLQSGVPSRF
SGSGSGTDFTLTISSLQPEDFATYYCQQSYSTPLTFGGGTKV
EIK (SEQ ID NO: 285)

Exemplary heavy chain and light chain CDRs (CDR-H1, CDR-H2 and CDR-H3, or CDR-L1, CDR-L2 and CDR-L3, respectively) for non-target ligand binding domains are shown in table 5 below.

TABLE 5

CDRs corresponding to antigen binding domains

| CDR-L1 | CDR-L2 | CDR-L3 | CDR-H1 | CDR-H2 | CDR-H3 |
|---|---|---|---|---|---|
| HLA-A*02 CDRs | | | | | |
| RSSQSIVHSNGNTYLE (SEQ ID NO: 101) | KVSNRFSGVPDR (SEQ ID NO: 102) | FQGSHVPRT (SEQ ID NO: 103) | ASGYTFTSYHIH (SEQ ID NO: 104) | WIYPGNVNTEYNEKFKGK (SEQ ID NO: 105) | EEITYAMDY (SEQ ID NO: 106) |
| RSSQSIVHSNGNTYLD (SEQ ID NO: 107) | KVSNRFSGVPDR (SEQ ID NO: 108) | MQGSHVPRT (SEQ ID NO: 109) | SGYTFTSYHMH (SEQ ID NO: 110) | WIYPGDSTQYNEKFKG (SEQ ID NO: 111) | EGTYYAMDY (SEQ ID NO: 112) |

TABLE 5-continued

CDRs corresponding to antigen binding domains

| CDR-L1 | CDR-L2 | CDR-L3 | CDR-H1 | CDR-H2 | CDR-H3 |
|---|---|---|---|---|---|
| HLA-A*03 CDRs | | | | | |
| RASQSISSYLN (SEQ ID NO: 286) | AASSLQS (SEQ ID NO: 293) | QQSYSTPLT (SEQ ID NO: 298) | SYGIS (SEQ ID NO: 305) | WISAYNGNT NYAQKLQG (SEQ ID NO: 326) | ERVSQRGAFD I (SEQ ID NO: 345) |
| RASQSISSYLN (SEQ ID NO: 286) | AASSLQS (SEQ ID NO: 293) | QQSYSTPLT (SEQ ID NO: 298) | SYSMN (SEQ ID NO: 306) | YISSSSSTIYYA DSVKG (SEQ ID NO: 327) | GNPDKDPFD Y (SEQ ID NO: 346) |
| RASQSISSYLN (SEQ ID NO: 286) | AASSLQS (SEQ ID NO: 293) | QQSYSTPLT (SEQ ID NO: 298) | SGSYYWS (SEQ ID NO: 307) | YIYYSGSTNYN PSLKS (SEQ ID NO: 328) | DFYCTNWYF DL (SEQ ID NO: 347) |
| RASQSISSYLN (SEQ ID NO: 286) | AASSLQS (SEQ ID NO: 293) | QQSYSTPLT (SEQ ID NO: 298) | SYYWS (SEQ ID NO: 308) | YIYYSGSTNYN PSLKS (SEQ ID NO: 328) | ESSSGSYWYF DL (SEQ ID NO: 348) |
| RASQSISSYLN (SEQ ID NO: 286) | AASSLQS (SEQ ID NO: 293) | QQSYSTPLT (SEQ ID NO: 298) | SYWIG (SEQ ID NO: 309) | IIYPGDSDTRY SPSFQG (SEQ ID NO: 329) | DSGYKYNLYY YYYYMDV (SEQ ID NO: 349) |
| ASSTGAVTSG YYPN (SEQ ID NO: 287) | STSNKHS (SEQ ID NO: 294) | LLYYGGAQW V (SEQ ID NO: 299) | SYGIS (SEQ ID NO: 305) | WISAYNGNT NYAQKLQG (SEQ ID NO: 326) | GGDLSHYYYY MDV (SEQ ID NO: 350) |
| RASQSISSYLN (SEQ ID NO: 286) | AASSLQS (SEQ ID NO: 293) | QQSYSTPLT (SEQ ID NO: 298) | SYGIS (SEQ ID NO: 305) | WISAYNGNT NYAQKLQG (SEQ ID NO: 326) | ENRRYNSCYY FDY (SEQ ID NO: 351) |
| ASSTGAVTSG YYPN (SEQ ID NO: 287) | STSNKHS (SEQ ID NO: 294) | LLYYGGAQW V (SEQ ID NO: 299) | SYGIS (SEQ ID NO: 305) | WISAYNGNT NYAQKLQG (SEQ ID NO: 326) | GGDLSHYYYY LDV (SEQ ID NO: 352) |
| RASQSISSYLN (SEQ ID NO: 286) | AASSLQS (SEQ ID NO: 293) | QQSYSTPLT (SEQ ID NO: 298) | SNYMS (SEQ ID NO: 310) | VIYSGGSTYYA DSVKG (SEQ ID NO: 330) | ATLLSLSYDAF Dl (SEQ ID NO: 353) |
| ASSTGAVTSG YYPN (SEQ ID NO: 287) | STSNKHS (SEQ ID NO: 294) | LLYYGGAQW V (SEQ ID NO: 299) | SYGIS (SEQ ID NO: 305) | WISAYNGNT NYAQKLQG (SEQ ID NO: 326) | GGDLSHYYYY MDV (SEQ ID NO: 354) |
| RASQSISSYLN (SEQ ID NO: 286) | AASSLQS (SEQ ID NO: 293) | QQSYSTPLT (SEQ ID NO: 298) | SYWIG (SEQ ID NO: 309) | IIYPGDSDTRY SPSFQG (SEQ ID NO: 329) | ERDRWFDP (SEQ ID NO: 355) |
| TGTSSDVGGY NYVS (SEQ ID NO: 288) | EVSKRPS (SEQ ID NO: 295) | SSYAGSNNW V (SEQ ID NO: 300) | SYGIS (SEQ ID NO: 305) | WISAYNGNT NYAQKLQG (SEQ ID NO: 326) | ETPPSLGAFDI (SEQ ID NO: 356) |
| SGSSSNIGSNT VN (SEQ ID NO: 289) | SNNQRPS (SEQ ID NO: 296) | AAWDDSLNG WV (SEQ ID NO: 301) | SSSYYWG (SEQ ID NO: 311) | SIYYSGSTYYN PSLKS (SEQ ID NO: 331) | EAYCLSDSYW YFDL (SEQ ID NO: 357) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | ESWKYFYPRG YMDV (SEQ ID NO: 358) |
| HLA-B*07 CDRs | | | | | |
| RASENIYSNLA (SEQ ID NO: 290) | AATYLPD (SEQ ID NO: 297) | QHFWVTPYT (SEQ ID NO: 302) | SGYSWH (SEQ ID NO: 313) | YIHFSGSTHYH PSLKS (SEQ ID NO: 333) | GGVVSHYAMDC (SEQ ID NO: 359) |
| HLA-A*11 CDRs | | | | | |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | HYYYYYMDV (SEQ ID NO: 360) |

TABLE 5-continued

CDRs corresponding to antigen binding domains

| CDR-L1 | CDR-L2 | CDR-L3 | CDR-H1 | CDR-H2 | CDR-H3 |
|---|---|---|---|---|---|
| RASQSISSYLN (SEQ ID NO: 286) | AASSLQS (SEQ ID NO: 293) | QQSYSTPLT SEQ ID NO: 298) | TSGVGVG (SEQ ID NO: 314) | LIYWNDDKRY SPSLKS (SEQ ID NO: 334) | KTTSFYFDY (SEQ ID NO: 361) |
| RASQSISSYLN (SEQ ID NO: 286) | AASSLQS (SEQ ID NO: 293) | QQSYSTPLT SEQ ID NO: 298) | SGGYYWS (SEQ ID NO: 312) | YIYYSGSTYYN PSLKS (SEQ ID NO: 332) | HYYYYMDV (SEQ ID NO: 362) |
| RASQSISSYLN (SEQ ID NO: 286) | AASSLQS (SEQ ID NO: 293) | QQSYSTPLT (SEQ ID NO: 298) | SYWMH (SEQ ID NO: 315) | RINSDGSSTSY ADSVKG (SEQ ID NO: 335) | GVLLYNWFD P (SEQ ID NO: 363) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | HYYYYYLDV (SEQ ID NO: 364) |
| RASQSISSYLN (SEQ ID NO: 286) | AASSLQS (SEQ ID NO: 293) | QQSYSTPLT (SEQ ID NO: 298) | SYDMH (SEQ ID NO: 316) | AIGTAGDTYY PGSVKG (SEQ ID NO: 336) | DLPGSYWYFD L (SEQ ID NO: 365) |
| RASQSISSYLN (SEQ ID NO: 286) | AASSLQS (SEQ ID NO: 293) | QQSYSTPLT (SEQ ID NO: 298) | SYAMH (SEQ ID NO: 317) | WINAGNGNT KYSQKFQG (SEQ ID NO: 337) | EGNGANPDA FDI (SEQ ID NO: 366) |
| RASQSISSYLN (SEQ ID NO: 286) | AASSLQS (SEQ ID NO: 293) | QQSYSTPLT (SEQ ID NO: 298) | TSGVGVG (SEQ ID NO: 314) | LIYWNDDKRY SPSLKS (SEQ ID NO: 334) | RHMRLSCFDY (SEQ ID NO: 367) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | HYYYYSMDV (SEQ ID NO: 368) |
| HLA-C*07 CDRs | | | | | |
| RASQSISSYLN (SEQ ID NO: 286) | AASSLQS (SEQ ID NO: 293) | QQSYSTPLT (SEQ ID NO: 298) | SYAMS (SEQ ID NO: 318) | AISGSGGSTYY ADSVKG (SEQ ID NO: 338) | SFDWFDP (SEQ ID NO: 369) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | ERSISPYYYYY MDV (SEQ ID NO: 370) |
| SGSSSNIGSNT VN (SEQ ID NO: 289) | SNNQRPS (SEQ ID NO: 296) | AAWDDSLNG WV (SEQ ID NO: 301) | SSSYYWG (SEQ ID NO: 311) | SIYYSGSTYYN PSLKS (SEQ ID NO: 331) | DSVIWYWFD P (SEQ ID NO: 371) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EEILPRLSYYY MDV (SEQ ID NO: 372) |
| RASQSISSYLN (SEQ ID NO: 286) | AASSLQS (SEQ ID NO: 293) | QQSYSTPLT (SEQ ID NO: 298) | SYAMN (SEQ ID NO: 319) | WINTNTGNP TYAQGFTG (SEQ ID NO: 339) | GGRAHSSWY FDL (SEQ ID NO: 373) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DRIKILPRLGY YYYMDV (SEQ ID NO: 374) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DTVIHYYYYM DV (SEQ ID NO: 375) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DVIVEVFLSYY YYMDV (SEQ ID NO: 376) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DIFIHYYYYM DV (SEQ ID NO: 377) |

TABLE 5-continued

CDRs corresponding to antigen binding domains

| CDR-L1 | CDR-L2 | CDR-L3 | CDR-H1 | CDR-H2 | CDR-H3 |
| --- | --- | --- | --- | --- | --- |
| RASQSISSYLN (SEQ ID NO: 286) | AASSLQS (SEQ ID NO: 293) | QQSYSTPLT (SEQ ID NO: 298) | SYSMN (SEQ ID NO: 306) | YISSSSSTIYYA DSVKG (SEQ ID NO: 327) | DGTFYSYSPYY FDY (SEQ ID NO: 378) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EWIKILPRLGY YYYMDV (SEQ ID NO: 379) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DRSLYYYYYM DV (SEQ ID NO: 380) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DKILAPNYYYY MDV (SEQ ID NO: 381) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EKSWKYFYYY YYYMDV (SEQ ID NO: 382) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | ENTSTIPYYYY YMDV (SEQ ID NO: 383) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EDVDKNTSTI YYYYYYMDV (SEQ ID NO: 384) |
| RASQGISSAL A (SEQ ID NO: 291) | DASSLES (SEQ ID NO: 55) | QQFNSYPLT (SEQ ID NO: 60) | DYYMS (SEQ ID NO: 320) | YISSSGSTIYYA DSVKG (SEQ ID NO: 340) | DGGDIVSSSAI YWYFDL (SEQ ID NO: 385) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DLILPPYYYYY MDV (SEQ ID NO: 386) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | ETWIKILPRYY YYYYYMDV (SEQ ID NO: 387) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DLSRYYYYYM DV (SEQ ID NO: 388) |
| RASQGISSWL A (SEQ ID NO: 292) | AASSLQS (SEQ ID NO: 293) | QQYNSYPLT (SEQ ID NO: 303) | SYSMN (SEQ ID NO: 306) | YISSSSSTIYYA DSVKG (SEQ ID NO: 327) | EHIVLCFDY (SEQ ID NO: 389) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DKILPRPYYYY YMDV (SEQ ID NO: 390) |
| TGTSSDVGGY NYVS (SEQ ID NO: 288) | EVSKRPS (SEQ ID NO: 295) | SSYAGSNNW V (SEQ ID NO: 300) | SYGIS (SEQ ID NO: 305) | WISAYNGNT NYAQKLQG (SEQ ID NO: 326) | GSNEYFQH (SEQ ID NO: 391) |
| RASQSISSYLN (SEQ ID NO: 286) | AASSLQS (SEQ ID NO: 293) | QQSYSTPLT (SEQ ID NO: 298) | SYAMN (SEQ ID NO: 319) | WINTNTGNP TYAQGFTG (SEQ ID NO: 339) | GTSYWYFDL (SEQ ID NO: 392) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EEIVEVFYYYY MDV (SEQ ID NO: 393) |
| RASQSISSYLN (SEQ ID NO: 286) | AASSLQS (SEQ ID NO: 293) | QQSYSTPLT (SEQ ID NO: 298) | SYAMS (SEQ ID NO: 318) | AISGSGGSTYY ADSVKG (SEQ ID NO: 338) | VDDYYFDY (SEQ ID NO: 394) |

TABLE 5-continued

CDRs corresponding to antigen binding domains

| CDR-L1 | CDR-L2 | CDR-L3 | CDR-H1 | CDR-H2 | CDR-H3 |
|---|---|---|---|---|---|
| RASQSISSYLN (SEQ ID NO: 286) | AASSLQS (SEQ ID NO: 293) | QQSYSTPLT (SEQ ID NO: 298) | SYWMH (SEQ ID NO: 315) | RINSDGSSTSY ADSVKG (SEQ ID NO: 335) | STNILLSYTKA FDI (SEQ ID NO: 395) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DKTYYYYYYM DV (SEQ ID NO: 396) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EKYFHDKYFH DYYYYYMDV (SEQ ID NO: 397) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DTSVYYYYYM DV (SEQ ID NO: 398) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EKILPYYYYYY MDV (SEQ ID NO: 399) |
| SGSSSNIGSNT VN (SEQ ID NO: 289) | SNNQRPS (SEQ ID NO: 296) | AAWDDSLNG WV (SEQ ID NO: 301) | SYSMN (SEQ ID NO: 306) | YISSSSSTIYYA DSVKG (SEQ ID NO: 327) | QWIYIYINPR GFIFLHDAPDI (SEQ ID NO: 400) |
| RASQSISSYLN (SEQ ID NO: 286) | AASSLQS (SEQ ID NO: 293) | QQSYSTPLT (SEQ ID NO: 298) | SNSAAWN (SEQ ID NO: 321) | RTYYRSKWYN DYAVSVKS (SEQ ID NO: 341) | EDVDFHHDA FDI (SEQ ID NO: 401) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EGVDKNTSTI YYYYYYMDV (SEQ ID NO: 402) |
| RASQGISSWL A (SEQ ID NO: 292) | AASSLQS (SEQ ID NO: 293) | QQYNSYPLT (SEQ ID NO: 303) | SYSMN (SEQ ID NO: 306) | YISSSSSTIYYA DSVKG (SEQ ID NO: 327) | DRRGYFDL (SEQ ID NO: 403) |
| RASQSISSYLN (SEQ ID NO: 286) | AASSLQS (SEQ ID NO: 293) | QQSYSTPLT (SEQ ID NO: 298) | DYYMH (SEQ ID NO: 322) | LVDPEDGETIY AEKFQG (SEQ ID NO: 342) | GIHVDIRSME DWFDP (SEQ ID NO: 404) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DIGTSYYYYM DV (SEQ ID NO: 405) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EVVEVFLYYY YMDV (SEQ ID NO: 406) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DLYYYYYYYM DV (SEQ ID NO: 407) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | ESWKYFPRG SIFIHYYYYMD V (SEQ ID NO: 408) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DRIVEVFYYYY MDV (SEQ ID NO: 409) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | EKYFHDWLYY YYYMDV (SEQ ID NO: 410) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DLVDKNTSYY YYYMDV (SEQ ID NO: 411) |

TABLE 5-continued

CDRs corresponding to antigen binding domains

| CDR-L1 | CDR-L2 | CDR-L3 | CDR-H1 | CDR-H2 | CDR-H3 |
|---|---|---|---|---|---|
| TGTSSDVGGY NYVS (SEQ ID NO: 288) | EVSKRPS (SEQ ID NO: 295) | SSYAGSNNW V (SEQ ID NO: 300) | SYGIS (SEQ ID NO: 305) | WISAYNGNT NYAQKLQG (SEQ ID NO: 326) | VQNEYFQH (SEQ ID NO: 412) |
| RASQGISSWL A (SEQ ID NO: 292) | AASSLQS (SEQ ID NO: 293) | QQANSFPLT (SEQ ID NO: 304) | DYYMS (SEQ ID NO: 320) | YISSSGSTIYYA DSVKG (SEQ ID NO: 340) | ANWFDP (SEQ ID NO: 413) |
| HLA-A*01 CDRs | | | | | |
| ASSTGAVTSG YYPN (SEQ ID NO: 287) | STSNKHS (SEQ ID NO: 294) | LLYYGGAQW V (SEQ ID NO: 299) | SYGIS (SEQ ID NO: 305) | WISAYNGNT NYAQKLQG (SEQ ID NO: 326) | GGWTAWYYY MDV (SEQ ID NO: 414) |
| SGSSSNIGSNT VN (SEQ ID NO: 289) | SNNQRPS (SEQ ID NO: 296) | AAWDDSLNG WV (SEQ ID NO: 301) | SYSMN (SEQ ID NO: 306) | YISSSSSTIYYA DSVKG (SEQ ID NO: 327) | AKYYYMDV (SEQ ID NO: 415) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DQVDKNTYYY YMDV (SEQ ID NO: 416) |
| RASQGISSWL A (SEQ ID NO: 292) | AASSLQS (SEQ ID NO: 293) | QQANSFPLT (SEQ ID NO: 304) | DYYMS (SEQ ID NO: 320) | YISSSGSTIYYA DSVKG (SEQ ID NO: 340) | ACQLAEYFQH (SEQ ID NO: 417) |
| RASQSISSYLN (SEQ ID NO: 286) | AASSLQS (SEQ ID NO: 293) | QQSYSTPLT (SEQ ID NO: 298) | SGGYYWS (SEQ ID NO: 312) | YIYYSGSTYYN PSLKS (SEQ ID NO: 332) | DRVDKNTSYY YMDV (SEQ ID NO: 418) |
| RASQSISSYLN (SEQ ID NO: 286) | AASSLQS (SEQ ID NO: 293) | QQSYSTPLT (SEQ ID NO: 298) | SSNWWG (SEQ ID NO: 323) | YIYYSGSTYYN PSLKS (SEQ ID NO: 332) | RVQLKLVHW FDP (SEQ ID NO: 419) |
| RASQSISSYLN (SEQ ID NO: 286) | AASSLQS (SEQ ID NO: 293) | QQSYSTPLT (SEQ ID NO: 298) | SYDIN (SEQ ID NO: 324) | WMNPNSGN TGYAQKFQG (SEQ ID NO: ) | YYDYVTVFYF QH (SEQ ID NO: 420) |
| RASQSISSYLN (SEQ ID NO: 286) | AASSLQS (SEQ ID NO: 293) | QQSYSTPLT (SEQ ID NO: 298) | SGGYSWS (SEQ ID NO: 325) | YIYHSGSTYYN PSLKS (SEQ ID NO: 344) | ESYPSFYAFDI (SEQ ID NO: 421) |
| RASQSISSYLN (SEQ ID NO: 286) | AASSLQS (SEQ ID NO: 293) | QQSYSTPLT (SEQ ID NO: 298) | TSGVGVG (SEQ ID NO: 314) | LIYWNDDKRY SPSLKS (SEQ ID NO: 334) | SNMWSYSLN DYYFDY (SEQ ID NO: 422) |

In some embodiments, the non-target antigen comprising HLA-A*02, and the ligand binding domain of the second receptor comprises an HLA-A*02 ligand binding domain. In some embodiments, the ligand binding domain binds HLA-A*02 independent of the peptide in a pMHC complex comprising HLA-A*02. In some embodiments, the HLA-A*02 ligand binding domain comprises an scFv domain. In some embodiments, the HLA-A*02 ligand binding domain comprises a sequence of any one of SEQ ID NOs: 89-100. In some embodiments, the HLA-A*02 ligand binding domain comprises a sequence at least 90%, at least 95% or at least 99% identical to a sequence of any one of SEQ ID NOs: 89-100.

In some embodiments, the HLA-A*02 scFv comprises the complementarity determined regions (CDRs) of any one of SEQ ID NOS: 101-112. In some embodiments, the scFv comprises a sequence at least 95% identical to any one of SEQ ID NOS: 101-112. In some embodiments, the scFv comprises a sequence identical to any one of SEQ ID NOS: 101-112. In some embodiments, the heavy chain of the antigen binding domain comprises the heavy chain CDRs of any one of SEQ ID NOS: 101-112, and wherein the light chain of the antigen binding domain comprises the light chain CDRs of any one of SEQ ID NOS: 101-112. In some embodiments, the HLA-A*02 antigen binding domain comprises a heavy chain and a light chain, and the heavy chain comprises CDRs selected from SEQ ID NOs: 104-106 and 110-112 and the light chain comprises CDRs selected from SEQ ID NOs: 101-103 and 107-109. In further embodiments of any of the ligand binding domains, each CDR sequence may have 1, 2, 3 or more substitutions, insertions, or deletions. CDR sequences may tolerate substitutions, deletions, or insertions. Using sequence alignment tools, routine experimentation, and known assays, those of skill in the art may generate and test variant sequences having 1, 2, 3, or more substitutions, insertions, or deletions in CDR sequences without undue experimentation.

In some embodiments, the HLA-A*02 antigen binding domain comprises a heavy chain and a light chain, and the heavy chain comprises a sequence at least 95% identical to the heavy chain portion of any one of SEQ ID NOS: 89-100, and the light chain comprises a sequence at least 95% identical to the light chain portion of any one of SEQ ID NOS: 89-100.

In some embodiments, the heavy chain comprises a sequence identical to the heavy chain portion of any one of SEQ ID NOS: 89-100, and wherein the light chain of comprises a sequence identical to the light chain portion of any one of SEQ ID NOS: 89-100.

In some embodiments, the non-target antigen comprises HLA-B*07, and the ligand binding domain of the second receptor comprises an HLA-B*07 ligand binding domain. In some embodiments, the ligand binding domain binds HLA-B*07 independent of the peptide in a pMHC complex comprising HLA-B*07. In some embodiments, the HLA-B*07 ligand binding domain comprises an scFv domain. In some embodiments, the HLA-B*07 ligand binding domain comprises a sequence of any one of the indicated B7 binding domains in Table 4. In some embodiments, the HLA-B*07 ligand binding domain comprises a sequence at least 90%, at least 95% or at least 99% identical to a sequence of any one of the indicated HLA-B*07 binding domains in Table 4. In some embodiments, the HLA-B*07 scFv comprises any one of the indicated HLA-B*07 complementarity determined regions (CDRs) in Table 5. In some embodiments, the scFv comprises a sequence at least 95% identical to any one of the indicated HLA-B*07 scFv sequences in Table 4. In some embodiments, the scFv comprises a sequence identical to any one of the indicated HLA-B*07 scFv sequences in Table 4.

In some embodiments, the non-target antigen comprises HLA-A*11, and the ligand binding domain of the second receptor comprises an HLA-A*11 ligand binding domain. In some embodiments, the ligand binding domain binds HLA-A*11 independent of the peptide in a pMHC complex comprising HLA-A*11. In some embodiments, the HLA-A*11 ligand binding domain comprises an scFv domain. In some embodiments, the HLA-A*11 ligand binding domain comprises a sequence of any one of the indicated HLA-A*11 binding domains in Table 4. In some embodiments, the HLA-A*11 ligand binding domain comprises a sequence at least 90%, at least 95% or at least 99% identical to a sequence of any one of the indicated HLA-A*11 binding domains in Table 4. In some embodiments, the HLA-A*11 scFv comprises any one of the indicated HLA-A*11 complementarity determined regions (CDRs) in Table 5. In some embodiments, the scFv comprises a sequence at least 95% identical to any one of the indicated HLA-A*11 scFv sequences in Table 4. In some embodiments, the scFv comprises a sequence identical to any one of the indicated HLA-A*11 scFv sequences in Table 4.

In some embodiments, the non-target antigen comprises HLA-A*01, and the ligand binding domain of the second receptor comprises an HLA-A*01 ligand binding domain. In some embodiments, the ligand binding domain binds HLA-A*01 independent of the peptide in a pMHC complex comprising HLA-A*01. In some embodiments, the HLA-A*01 ligand binding domain comprises an scFv domain. In some embodiments, the HLA-A*01 ligand binding domain comprises a sequence of any one of the indicated HLA-A*01 binding domains in Table 4. In some embodiments, the HLA-A*01 ligand binding domain comprises a sequence at least 90%, at least 95% or at least 99% identical to a sequence of any one of the indicated HLA-A*01 binding domains in Table 4. In some embodiments, the HLA-A*01 scFv comprises any one of the indicated HLA-A*01 complementarity determined regions (CDRs) in Table 5. In some embodiments, the scFv comprises a sequence at least 95% identical to any one of the indicated HLA-A*01 scFv sequences in Table 4. In some embodiments, the scFv comprises a sequence identical to any one of the indicated HLA-A*01 scFv sequences in Table 4.

In some embodiments, the non-target antigen comprises HLA-A*03, and the ligand binding domain of the second receptor comprises an HLA-A*03 ligand binding domain. In some embodiments, the ligand binding domain binds HLA-A*03 independent of the peptide in a pMHC complex comprising HLA-A*03. In some embodiments, the HLA-A*03 ligand binding domain comprises an scFv domain. In some embodiments, the HLA-A*03 ligand binding domain comprises a sequence of any one of the indicated HLA-A*03 binding domains in Table 4. In some embodiments, the HLA-A*03 ligand binding domain comprises a sequence at least 90%, at least 95% or at least 99% identical to a sequence of any one of the indicated HLA-A*03 binding domains in Table 4. In some embodiments, the HLA-A*03 scFv comprises any one of the indicated HLA-A*03 complementarity determined regions (CDRs) in Table 5. In some embodiments, the scFv comprises a sequence at least 95% identical to any one of the indicated HLA-A*03 scFv sequences in Table 4. In some embodiments, the scFv comprises a sequence identical to any one of the indicated HLA-A*03 scFv sequences in Table 4.

In some embodiments, the non-target antigen comprises HLA-C*07, and the ligand binding domain of the second receptor comprises an HLA-C*07 ligand binding domain. In some embodiments, the ligand binding domain binds HLA-C*07 independent of the peptide in a pMHC complex comprising HLA-C*07. In some embodiments, the HLA-C*07 ligand binding domain comprises an scFv domain. In some embodiments, the HLA-C*07 ligand binding domain comprises a sequence of any one of the indicated HLA-C*07 binding domains in Table 4. In some embodiments, the HLA-C*07 ligand binding domain comprises a sequence at least 90%, at least 95% or at least 99% identical to a sequence of any one of the indicated HLA-C*07 binding domains in Table 4. In some embodiments, the HLA-C*07 scFv comprises any one of the indicated HLA-C*07 complementarity determined regions (CDRs) in Table 5. In some embodiments, the scFv comprises a sequence at least 95% identical to any one of the indicated HLA-C*07 scFv sequences in Table 4. In some embodiments, the scFv comprises a sequence identical to any one of the indicated HLA-C*07 scFv sequences in Table 4.

Inhibitory Receptors

The disclosure provides a second receptor that is an inhibitory chimeric antigen receptor (i.e. inhibitory receptor). The inhibitory receptor may comprise an extracellular ligand binding domain that binds to and recognizes the non-target antigen or a peptide derivative thereof in an MHC-I complex.

Exemplary inhibitory receptors are described in PCT/US2020/045228 filed on Sep. 6, 2020, PCT/US2020/064607, filed on Dec. 11, 2020, PCT/US2021/029907, filed on Apr. 29, 2021 and PCT/US2020/059856 filed on Nov. 10, 2020, the contents of each of which are incorporated herein by reference.

The non-target antigen can be a non-target allelic variant. A "non-target allelic variant" as used herein refers to an allele (e.g. an allelic variant of an MHC Class I gene), whose expression is reduced or eliminated in a target cell (e.g. a cancer cell) due to loss of heterozygosity, or another mechanism of expression loss, but is expressed or detectably expressed in a normal or healthy cell.

The term "inhibitory chimeric antigen receptor" or "inhibitory receptor" as used herein refers to an antigen-binding domain that is fused to an intracellular signaling domain capable of transducing an inhibitory signal that inhibits or suppresses the immune activity of an immune cell. Inhibitory receptors have immune cell inhibitory potential, and are distinct and distinguishable from CARs, which are receptors with immune cell activating potential. For example, CARs are activating receptors as they include intracellular stimulatory and/or co-stimulatory domains. Inhibitory receptors are inhibiting receptors that contain intracellular inhibitory domains.

As used herein "inhibitory signal" refers to signal transduction or changes in protein expression in an immune cell resulting in suppression of an immune response (e.g., decrease in cytokine production or reduction of immune cell activation). Inhibition or suppression of an immune cell can selective and/or reversible, or not selective and/or reversible. Inhibitory receptors are responsive to non-target antigens (e.g. HLA-A*02). For example, when a non-target antigen (e.g. HLA-A*02) binds to or contacts the inhibitory receptor, the inhibitory receptor is responsive and activates an inhibitory signal in the immune cell expressing the inhibitory receptor upon binding of the non-target antigen by the extracellular ligand binding domain of the inhibitory receptor.

Inhibitory receptors of the disclosure may comprise an extracellular ligand binding domain. Any type of ligand binding domain that can regulate the activity of a receptor in a ligand dependent manner is envisaged as within the scope of the instant disclosure.

In some embodiments, the ligand binding domain is an antigen binding domain. Exemplary antigen binding domains include, inter alia, scFv, SdAb, Vβ-only domains, and TCR antigen binding domains derived from the TCR α and β chain variable domains.

Any type of antigen binding domain is envisaged as within the scope of the instant disclosure.

In some embodiments, the extracellular ligand binding domain of the second receptor binds to and recognizes a polymorphic variant of COLEC12, APCDD1, CXCL16 or an antigen peptide thereof in a complex with a major histocompatibility complex class I (MHC-I), or HLA-A*02. In some embodiments, the extracellular ligand binding domain of the second receptor is an scFv.

In some embodiments, the extracellular ligand binding domain of the second receptor is fused to the extracellular domain of an inhibitory receptor.

In some embodiments, the inhibitory receptors of the present disclosure comprise an extracellular hinge region. Exemplary hinges can be isolated or derived from IgD and CD8 domains, for example IgG1. In some embodiments, the hinge is isolated or derived from CD8α or CD28.

The inhibitory receptors of the present disclosure can be designed to comprise a transmembrane domain that is fused to the extracellular domain of the inhibitory receptors. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD3γ, CD64, CD80, CD86, CD134, CD137, CD154, or from an immunoglobulin such as IgG4. Alternatively, the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the intracellular domain of the inhibitory receptors. A glycine-serine doublet provides a particularly suitable linker.

The disclosure provides an inhibitory receptors comprising an intracellular domain. The intracellular domain of the inhibitory receptors of the instant disclosure is responsible for inhibiting activation of the immune cells comprising the inhibitory receptors, which would otherwise be activated in response to activation signals by the first receptor. In some embodiments, the inhibitory intracellular domain comprises an immunoreceptor tyrosine-based inhibitory motif (ITIM). In some embodiments, the inhibitory intracellular domain comprising an ITIM can be isolated or derived from an immune checkpoint inhibitor such as CTLA-4 and PD-1. CTLA-4 and PD-1 are immune inhibitory receptors expressed on the surface of T cells, and play a pivotal role in attenuating or terminating T cell responses.

In some embodiments, an inhibitory intracellular domain is isolated from human tumor necrosis factor related apoptosis inducing ligand (TRAIL) receptor and CD200 receptor 1. In some embodiments, the TRAIL receptor comprises TR10A, TR10B or TR10D.

In some embodiments, an inhibitory intracellular domain is isolated from phosphoprotein membrane anchor with glycosphingolipid microdomains 1 (PAG1). In some embodiments, an inhibitory intracellular domain is isolated from leukocyte immunoglobulin like receptor B1 (LILRB1).

In some embodiments, the inhibitory domain is isolated or derived from a human protein, for example a human TRAIL receptor, CTLA-4, PD-1, PAG1 or LILRB1 protein.

In some embodiments, the inhibitory domain comprises an intracellular domain, a transmembrane or a combination thereof. In some embodiments, the inhibitory domain comprises an intracellular domain, a transmembrane domain, a hinge region or a combination thereof.

In some embodiments, the inhibitory domain is isolated or derived from killer cell immunoglobulin like receptor, three Ig domains and long cytoplasmic tail 2 (KIR3DL2), killer cell immunoglobulin like receptor, three Ig domains and long cytoplasmic tail 3 (KIR3DL3), leukocyte immunoglobulin like receptor B1 (LIR1, also called LIR-1 and LILRB1), programmed cell death 1 (PD-1), Fc gamma receptor IIB (FcgRIIB), killer cell lectin like receptor K1 (NKG2D), CTLA-4, a domain containing a synthetic consensus ITIM, a ZAP70 SH2 domain (e.g., one or both of the N and C terminal SH2 domains), or ZAP70 KI_K369A (kinase inactive ZAP70).

In some embodiments, the inhibitory domain is isolated or derived from a human protein.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory intracellular domain is fused to an intracellular domain of an inhibitory receptors. In some embodiments, the inhibitory intracellular domain is fused to the transmembrane domain of an inhibitory receptors.

In some embodiments, the second, inhibitory receptor comprises a cytoplasmic domain, a transmembrane domain, and an extracellular domain or a portion thereof isolated or derived isolated or derived from the same protein, for example an ITIM containing protein. In some embodiments, the second, inhibitory receptor comprises a hinge region isolated or derived from isolated or derived from the same protein as the intracellular domain and/or transmembrane domain, for example an ITIM containing protein.

In some embodiments, the second receptor is a TCR comprising an inhibitory domain (an inhibitory TCR). In some embodiments, the inhibitory TCR comprises an inhibitory intracellular domain and/or an inhibitory transmembrane domain. In some embodiments, the inhibitory intracellular domain is fused to the intracellular domain of TCR alpha, TCR beta, CD3 delta, CD3 gamma or CD3 epsilon or a portion thereof a TCR. In some embodiments, the inhibitory intracellular domain is fused to the transmembrane domain of TCR alpha, TCR beta, CD3 delta, CD3 gamma or CD3 epsilon.

In some embodiments, the second receptor is a TCR comprising an inhibitory domain (an inhibitory TCR). In some embodiments, the inhibitory domain is isolated or derived from LILRB1.

LILRB1 Inhibitory Receptors

The disclosure provides a second, inhibitory receptor comprising a LILRB1 inhibitory domain, and optionally, a LILRB1 transmembrane and/or hinge domain, or functional variants thereof. The inclusion of the LILRB1 transmembrane domain and/or the LILRB1 hinge domain in the inhibitory receptor may increase the inhibitory signal generated by the inhibitory receptor compared to a reference inhibitory receptor having another transmembrane domain or another hinge domains. The second, inhibitory receptor comprising the LILRB1 inhibitory domain may be a CAR or TCR, as described herein. Any suitable ligand binding domain, as described herein, may be fused to the LILRB1-based second, inhibitory receptors.

Leukocyte immunoglobulin-like receptor subfamily B member 1 (LILRB1), also known as Leukocyte immunoglobulin-like receptor B1, as well as ILT2, LIR1, MIR7, PTRB, CD85J, TLT-2 LIR-1, MIR-7 and PIR-B, is a member of the leukocyte immunoglobulin-like receptor (LIR) family. The LILRB1 protein belongs to the subfamily B class of LIR receptors. These receptors contain two to four extracellular immunoglobulin domains, a transmembrane domain, and two to four cytoplasmic immunoreceptor tyrosine-based inhibitory motifs (ITIMs). The LILRB1 receptor is expressed on immune cells, where it binds to MHC class I molecules on antigen-presenting cells and transduces a negative signal that inhibits stimulation of an immune response. LILRB1 is thought to regulate inflammatory responses, as well as cytotoxicity, and to play a role in limiting auto-reactivity. Multiple transcript variants encoding different isoforms of LILRB1 exist, all of which are contemplated as within the scope of the instant disclosure.

In some embodiments of the inhibitory receptors described herein, the inhibitory receptor comprises one or more domains isolated or derived from LILRB1. In some embodiments of the receptors having one or more domains isolated or derived from LILRB1, the one or more domains of LILRB1 comprise an amino acid sequence that is at least 80%, at least 90%, at least 95%, at least 96%, at least 97%, at least 98%, at least 99% or is identical to a sequence or subsequence of SEQ ID NO: 113. In some embodiments, the one or more domains of LILRB1 comprise an amino acid sequence that is identical to a sequence or subsequence of SEQ ID NO: 113. In some embodiments, the one or more domains of LILRB1 consist of an amino acid sequence that is at least 80%, at least 90%, at least 95%, at least 96%, at least 97%, at least 98%, at least 99% or is identical to a sequence or subsequence of SEQ ID NO: 113. In some embodiments, the one or more domains of LILRB1 consist of an amino acid sequence that is identical to a sequence or subsequence of SEQ ID NO: 113.

In some embodiments of the receptors having one or more domains isolated or derived from LILRB1, the one or more domains of LILRB1 are encoded by a polynucleotide sequence that is at least 80%, at least 90%, at least 95%, at least 96%, at least 97%, at least 98%, at least 99% or is identical to a sequence or subsequence of

```
                                                              (SEQ ID NO: 114)
  1    aaatgagttt  taaaaaggct  tgtccaggaa  gcacatatgg  gagctggtca  ctctgcattt 61    tgggccctcc  tggaggtgtt  tagaccttcc  gagagagaaa  ctgagacaca  tgagagggaa 121    gaaatgactc  agtggtgaga  ccctgtggag  tcccacccac  aaccagcaca  ctgtgaccca 181    ctgcacaaac  ctctagccca  cagctcactt  cctcctttaa  gaagagaaga  gaaaagagga 241    gaggagagga  ggaacagaaa  agaaaagaaa  agaaaagtg   ggaaacaaat  aatctaagaa 301    tgagagaaa   gcaagaagag  tgacccctt   gtgggcactc  cattggtttt  atggcgcctc 361    tactttctgg  agtttgtgta  aaacaaaaat  attatggtct  ttgtgcacat  ttacatcaag 421    ctcagcctgg  gcggcacagc  cagatgcgag  atcgtctct   gctgatctga  gtctgcctgc 481    agcatggacc  tgggtcttcc  ctgaagcatc  tccaggctg   gagggacgac  tgccatgcac 541    cgagggctca  tccatccaca  gagcagggca  gtgggaggag  acgccatgac  ccccatcctc 601    acggtcctga  tctgtctcgg  gctgagtctg  ggcccccgga  cccacgtgca  ggcagggcac 661    ctccccaagc  ccaccctctg  ggctgaacca  ggctctgtga  tcacccaggg  gagtcctgtg 721    accctcaggt  gtcagggggg  ccaggagacc  caggagtacc  gtctatatag  agaaaagaaa 781    acagcaccct  ggattacacg  gatcccacag  gagcttgtga  agaagggcca  gttccccatc 841    ccatccatca  cctgggaaca  cacagggcgg  tatcgctgtt  actatggtag  cgacactgca
```

-continued

```
 901  ggccgctcag agagcagtga ccccctggag ctggtggtga caggagccta catcaaaccc
 961  accctctcag cccagcccag ccccgtggtg aactcaggag ggaatgtaac cctccagtgt
1021  gactcacagg tggcatttga tggcttcatt ctgtgtaagg aaggagaaga tgaacaccca
1081  caatgcctga actcccagcc ccatgcccgt gggtcgtccc gcgccatctt ctccgtgggc
1141  cccgtgagcc cgagtcgcag gtggtggtac aggtgctatg cttatgactc gaactctccc
1201  tatgagtggt ctctacccag tgatctcctg gagctcctgg tcctaggtgt ttctaagaag
1261  ccatcactct cagtgcagcc aggtcctatc gtggcccctg aggagaccct gactctgcag
1321  tgtggctctg atgctggcta caacagattt gttctgtata aggacgggga acgtgacttc
1381  cttcagctcg ctggcgcaca gccccaggct gggctctccc aggccaactt caccctgggc
1441  cctgtgagcc gctcctacgg gggccagtac agatgctacg gtgcacacaa cctctcctcc
1501  gagtggtcgg cccccagcga ccccctggac atcctgatcg caggacagtt ctatgacaga
1561  gtctccctct cggtgcagcc gggccccacg gtggcctcag agagaacgt gaccctgctg
1621  tgtcagtcac agggatggat gcaaactttc cttctgacca aggaggggc agctgatgac
1681  ccatggcgtc taagatcaac gtaccaatct caaaaatacc aggctgaatt ccccatgggt
1741  cctgtgacct cagcccatgc ggggacctac aggtgctacg gctcacagag ctccaaaccc
1801  tacctgctga ctcaccccag tgacccctg gagctcgtgg tctcaggacc gtctggggc
1861  cccagctccc cgacaacagg ccccacctcc acatctggcc ctgaggacca gccctcacc
1921  cccaccgggt cggatcccca gagtggtctg ggaaggcacc tgggggttgt gatcggcatc
1981  ttggtggccg tcatcctact gctcctcctc ctcctcctcc tcttcctcat cctccgacat
2041  cgacgtcagg gcaaacactg gacatcgacc cagagaaagg ctgatttcca acatcctgca
2101  ggggctgtgg ggccagagcc cacagacaga ggcctgcagt ggaggtccag cccagctgcc
2161  gatgcccagg aagaaaacct ctatgctgcc gtgaagcaca cacagcctga ggatggggtg
2221  gagatggaca ctcggagccc acacgatgaa gacccccagg cagtgacgta tgccgaggtg
2281  aaacactcca gacctaggag agaaatggcc tctcctcctt ccccactgtc tggggaattc
2341  ctggacacaa aggacagaca ggcggaagag gacaggcaga tggacactga ggctgctgca
2401  tctgaagccc cccaggatgt gacctacgcc cagctgcaca gcttgaccct cagacgggag
2461  gcaactgagc ctcctccatc ccaggaaggg ccctctccag ctgtgcccag catctacgcc
2521  actctggcca tccactagcc cagggggga cgcagacccc acactccatg gagtctggaa
2581  tgcatgggag ctgcccccc agtggacacc attggacccc acccagcctg gatctacccc
2641  aggagactct gggaactttt aggggtcact caattctgca gtataaataa ctaatgtctc
2701  tacaattttg aaataaagca acagacttct caataatcaa tgaagtagct gagaaaacta
2761  agtcagaaag tgcattaaac tgaatcacaa tgtaaatatt acacatcaag cgatgaaact
2821  ggaaaactac aagccacgaa tgaatgaatt aggaaagaaa aaagtagga aatgaatgat
2881  cttggctttc ctataagaaa tttagggcag ggcacggtgg ctcacgcctg taattccagc
2941  actttgggag gccgaggcgg gcagatcacg agttcaggag atcgagacca tcttggccaa
3001  catggtgaaa ccctgtctct cctaaaaata caaaaattag ctggatgtgg tggcagtgcc
3061  tgtaatccca gctatttggg aggctgaggc aggagaatcg cttgaaccag ggagtcagag
3121  gtttcagtga gccaagatcg caccactgct ctccagcctg gcgacagagg gagactccat
3181  ctcaaattaa aaaaaaaaa aaaaagaaa gaaaaaaaaa aaaaaaaa.
```

In some embodiments of the receptors having one or more domains of LILRB1, the one or more domains of LILRB1 are encoded by a polynucleotide sequence that is identical to a sequence or subsequence of SEQ ID NO: 114.

In various embodiments, an inhibitory receptor is provided, comprising a polypeptide, wherein the polypeptide comprises one or more of: an LILRB1 hinge domain or functional fragment or variant thereof, an LILRB1 transmembrane domain or a functional variant thereof, and an LILRB1 intracellular domain or an intracellular domain comprising at least one, or at least two immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

As used herein an "immunoreceptor tyrosine-based inhibitory motif" or "ITIM" refers to a conserved sequence of amino acids with a consensus sequence of S/I/V/LxYxxI/V/L (SEQ ID NO: 423), or the like, that is found in the cytoplasmic tails of many inhibitory receptors of the immune system. After ITIM-possessing inhibitory receptors interact with their ligand, the ITIM motif is phosphorylated, allowing the inhibitory receptor to recruit other enzymes, such as the phosphotyrosine phosphatases SHP-1 and SHP-2, or the inositol-phosphatase called SHIP.

In some embodiments, the polypeptide comprises an intracellular domain comprising at least one immunoreceptor tyrosine-based inhibitory motif (ITIM), at least two ITIMs, at least 3 ITIMs, at least 4 ITIMs, at least 5 ITIMs or at least 6 ITIMs. In some embodiments, the intracellular domain has 1, 2, 3, 4, 5, or 6 ITTIMs.

In some embodiments, the polypeptide comprises an intracellular domain comprising at least one ITIM selected from the group of ITIMs consisting of NLYAAV (SEQ ID NO: 115), VTYAEV (SEQ ID NO: 116), VTYAQL (SEQ ID NO: 117), and SIYATL (SEQ ID NO: 118).

In further particular embodiments, the polypeptide comprises an intracellular domain comprising at least two immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In some embodiments, the intracellular domain comprises both ITIMs NLYAAV (SEQ ID NO: 115) and VTYAEV (SEQ ID NO: 116). In some embodiments, the intracellular domain comprises a sequence at least 95% identical to SEQ ID NO: 119. In some embodiments, the intracellular domain comprises or consists essentially of a sequence identical to SEQ ID NO: 119.

In some embodiments, the intracellular domain comprises both ITIMs VTYAEV (SEQ ID NO: 116) and VTYAQL (SEQ ID NO: 117). In some embodiments, the intracellular domain comprises a sequence at least 95% identical to SEQ ID NO: 120. In some embodiments, the intracellular domain comprises or consists essentially of a sequence identical to SEQ ID NO: 120.

In some embodiments, the intracellular domain comprises both ITIMs VTYAQL (SEQ ID NO: 117) and SIYATL (SEQ ID NO: 118). In some embodiments, the intracellular domain comprises a sequence at least 95% identical to SEQ ID NO: 121. In some embodiments, the intracellular domain comprises or consists essentially of a sequence identical to SEQ ID NO: 121.

In some embodiments, the intracellular domain comprises the ITIMs NLYAAV (SEQ ID NO: 115), VTYAEV (SEQ ID NO: 116), and VTYAQL (SEQ ID NO: 117). In some embodiments, the intracellular domain comprises a sequence at least 95% identical to SEQ ID NO: 122. In some embodiments, the intracellular domain comprises or consists essentially of a sequence identical to SEQ ID NO: 122.

In some embodiments, the intracellular domain comprises the ITIMs VTYAEV (SEQ ID NO: 116), VTYAQL (SEQ ID NO: 117), and SIYATL (SEQ ID NO: 118). In some embodiments, the intracellular domain comprises a sequence at least 95% identical to SEQ ID NO: 123. In some embodiments, the intracellular domain comprises or consists essentially of a sequence identical to SEQ ID NO: 123.

In some embodiments, the intracellular domain comprises the ITIMs NLYAAV (SEQ ID NO: 115), VTYAEV (SEQ ID NO: 116), VTYAQL (SEQ ID NO: 117), and SIYATL (SEQ ID NO: 118). In embodiments, the intracellular domain comprises a sequence at least 95% identical to SEQ ID NO: 124. In some embodiments, the intracellular domain comprises or consists essentially of a sequence identical to SEQ ID NO: 124.

In some embodiments, the intracellular domain comprises a sequence at least 95% identical to the LILRB1 intracellular domain (SEQ ID NO: 129). In some embodiments, the intracellular domain comprises or consists essentially of a sequence identical to the LILRB1 intracellular domain (SEQ ID NO: 129).

LILRB1 intracellular domains or functional variants thereof of the disclosure can have at least 1, at least 2, at least 4, at least 4, at least 5, at least 6, at least 7, or at least 8 ITIMs. In some embodiments, the LILRB1 intracellular domain or functional variant thereof has 2, 3, 4, 5, or 6 ITIMs.

In particular embodiments, the intracellular domain comprises two, three, four, five, or six immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises at least three immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises three immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises four immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises five immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises six immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In particular embodiments, the intracellular domain comprises at least seven immunoreceptor tyrosine-based inhibitory motifs (ITIMs), wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

The LILRB1 protein has four immunoglobulin (Ig) like domains termed D1, D2, D3 and D4. In some embodiments, the LILRB1 hinge domain comprises an LILRB1 D3D4 domain or a functional variant thereof. In some embodiments, the LILRB1 D3D4 domain comprises a sequence at least 95%, at least 96%, at least 97%, at least 98%, at least 99% or identical to SEQ ID NO: 125. In some embodiments, the LILRB1 D3D4 domain comprises or consists essentially of SEQ ID NO: 125.

In some embodiments, the polypeptide comprises the LILRB1 hinge domain or functional fragment or variant thereof. In embodiments, the LILRB1 hinge domain or functional fragment or variant thereof comprises a sequence at least 95%, at least 96%, at least 97%, at least 98%, at least 99% identical or identical to SEQ ID NO: 132, SEQ ID NO: 125, or SEQ ID NO: 126. In embodiments, the LILRB1 hinge domain or functional fragment or variant thereof comprises a sequence at least 95% identical to SEQ ID NO: 132, SEQ ID NO: 125, or SEQ ID NO: 126.

In some embodiments, the LILRB1 hinge domain comprises a sequence identical to SEQ ID NO: 132, SEQ ID NO: 125, or SEQ ID NO: 126.

In some embodiments, the LILRB1 hinge domain consists essentially of a sequence identical to SEQ ID NO: 132, SEQ ID NO: 125, or SEQ ID NO: 126.

In some embodiments, the transmembrane domain is a LILRB1 transmembrane domain or a functional variant thereof. In some embodiments, the LILRB1 transmembrane domain or a functional variant thereof comprises a sequence at least 95% identical, at least 96% identical, at least 97% identical, at least 98% identical or at least 99% to SEQ ID NO: 133. In some embodiments, the LILRB1 transmembrane domain or a functional variant thereof comprises a sequence at least 95% identical to SEQ ID NO: 133. In some embodiments, the LILRB1 transmembrane domain comprises a sequence identical to SEQ ID NO: 133. In embodiments, the LILRB1 transmembrane domain consists essentially of a sequence identical to SEQ ID NO: 133.

In some embodiments, the transmembrane domain can be attached to the extracellular region of the second, inhibitory receptor, e.g., the antigen binding domain or ligand binding domain, via a hinge, e.g., a hinge from a human protein. For example, in some embodiments, the hinge can be a human immunoglobulin (Ig) hinge, e.g., an IgG4 hinge, a CD8a hinge or an LILRB1 hinge.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory domain is isolated or derived from LILR1B.

Inhibitory Receptors Comprising Combinations of LILRB1 Domains

In some embodiments, the LILRB1-based inhibitory receptors of the disclosure comprise more than one LILRB1 domain or functional equivalent thereof. For example, in some embodiments, the inhibitory receptor comprises an LILRB1 transmembrane domain and intracellular domain, or an LILRB1 hinge domain, transmembrane domain and intracellular domain.

In particular embodiments, the inhibitory receptor comprises an LILRB1 hinge domain or functional fragment or variant thereof, and the LILRB1 transmembrane domain or a functional variant thereof. In some embodiments, the polypeptide comprises a sequence at least 95% identical, at least 96% identical, at least 97% identical, at least 98% identical, at least 99% identical or identical to SEQ ID NO: 127. In some embodiments, the polypeptide comprises a sequence at least 95% identical to SEQ ID NO: 127. In some embodiments, the polypeptide comprises a sequence identical to SEQ ID NO: 127.

In further embodiments, the inhibitory receptor comprises: the LILRB1 transmembrane domain or a functional variant thereof, and an LILRB1 intracellular domain and/or an intracellular domain comprising at least one immunoreceptor tyrosine-based inhibitory motif (ITIM), wherein the ITIM is selected from NLYAAV (SEQ ID NO: 115), VTYAEV (SEQ ID NO: 116), VTYAQL (SEQ ID NO: 117), and SIYATL (SEQ ID NO: 118). In some embodiments, the polypeptide comprises the LILRB1 transmembrane domain or a functional variant thereof, and an LILRB1 intracellular domain and/or an intracellular domain comprising at least two ITIM, wherein each ITIM is independently selected from NLYAAV (SEQ ID NO: 115), VTYAEV (SEQ ID NO: 116), VTYAQL (SEQ ID NO: 117), and SIYATL (SEQ ID NO: 118).

In some embodiments, the inhibitory receptor comprises a LILRB1 transmembrane domain and intracellular domain. In some embodiments, the polypeptide comprises a sequence at least 95% identical, at least 96% identical, at least 97% identical, at least 98% identical, at least 99% identical or identical to SEQ ID NO: 128. In some embodiments, the polypeptide comprises a sequence at least 95% identical to SEQ ID NO: 128. In some embodiments, the polypeptide comprises a sequence identical to SEQ ID NO: 128.

In preferred embodiments, the inhibitory receptor comprises: an LILRB1 hinge domain or functional fragment or variant thereof, an LILRB1 transmembrane domain or a functional variant thereof; and an LILRB1 intracellular domain and/or an intracellular domain comprising at least two immunoreceptor tyrosine-based inhibitory motifs (ITIMs), wherein each ITIM is independently selected from LYAAV (SEQ ID NO: 115), VTYAE (SEQ ID NO: 116), VTYAQL (SEQ ID NO: 117), and SIYATL (SEQ ID NO: 118).

In some embodiments, the inhibitory receptor comprises a sequence at least 95% identical to SEQ ID NO: 130 or SEQ ID NO: 131, or at least 99% identical to SEQ ID NO: 130 or SEQ ID NO: 131, or identical to SEQ ID NO: 130 or SEQ ID NO: 131.

In some embodiments, the polypeptide comprises a sequence at least 99% identical to SEQ ID NO: 127, or at least 99% identical to SEQ ID NO: 127, or identical to SEQ ID NO: 127.

In some embodiments, the polypeptide comprises a sequence at least 99% identical to SEQ ID NO: 128, or at least 99% identical to SEQ ID NO: 128, or identical to SEQ ID NO: 128.

TABLE 6

Polypeptide sequences for illustrative LILRB1-based inhibitory receptors

| Name | Sequence |
|---|---|
| LILRB1 | MTPILTVLICLGLSLGPRTHVQAGHLPKPTLWAEPGSVITQ GSPVTLRCQGGQETQEYRLYREKKTALWITRIPQELVKKG QFPIPSITWEHAGRYRCYYGSDTAGRSESSSDPLELVVTGA YIKPTLSAQPSPVVNSGGNVILQCDSQVAFDGFSLCKEGED EHPQCLNSQPHARGSSRAIFSVGPVSPSRRWWYRCYAYDS NSPYEWSLPSDLLELLVLGVSKKPSLSVQPGPIVAPEETLT LQCGSDAGYNRFVLYKDGERDFLQLAGAQPQAGLSQANF TLGPVSRSYGGQYRCYGAHNLSSEWSAPSDPLDILIAGQF YDRVSLSVQPGPTVASGENVTLLCQSQGWMQTFLLTKEG AADDPWRLRSTYQSQKYQAEFPMGPVTSAHAGTYRCYG SQSSKPYLLTHPSDPLELVVSGPSGGPSSPTTGPTSTSGPE DQPLTPTGSDPQSGLGRHLGVVIGILVAVILLLLLLLLFLI LRHRRQGKHWTSTQRKADFQHPAGAVGPEPTDRGLQWR SSPAADAQEENLYAAVKHTQPEDGVEMDTRSPHDEDPQA VTYAEVKHSRPRREMASPPSPLSGEFLDTKDRQAEEDRQ MDTEAAASEAPQDVTYAQLHSLTLRREATEPPPSQEGPSP AVPSIYATLAIHPSQEGPSPAVPSIYATLAIH<br>SEQ ID NO: 113 |
| LILRB1 hinge-transmembrane-intracellular domain | YGSQSSKPYLLTHPSDPLELVVSGPSGGPSSPTTGPTSTSG PEDQPLTPTGSDPQSGLGRHLGVVIGILVAVILLLLLLLL FLILRHRRQGKHWTSTQRKADFQHPAGAVGPEPTDRGLQ WRSSPAADAQEENLYAAVKHTQPEDGVEMDTRSPHDEDP QAVTYAEVKHSRPRREMASPPSPLSGEFLDTKDRQAEEDR QMDTEAAASEAPQDVTYAQLHSLTLRREATEPPPSQEGPS PAVPSIYATLAIH<br>SEQ ID NO: 130 |
| LILRB1 hinge-transmembrane-intracellular domain (w/o YGSQSSKPYLLTHPSD PLEL) | VVSGPSGGPSSPTTGPTSTSGPEDQPLTPTGSDPQSGLGRH LGVVIGILVAVILLLLLLLLFLILRHRRQGKHWTSTQRK ADFQHPAGAVGPEPTDRGLQWRSSPAADAQEENLYAAV KHTQPEDGVEMDTRSPHDEDPQAVTYAEVKHSRPRREMA SPPSPLSGEFLDTKDRQAEEDRQMDTEAAASEAPQDVTYA QLHSLTLRREATEPPPSQEGPSPAVPSIYATLAIH<br>SEQ ID NO: 131 |
| LILRB1 hinge domain | YGSQSSKPYLLTHPSDPLELVVSGPSGGPSSPTTGPTSTSG PEDQPLTPTGSDPQSGLGRHLG<br>SEQ ID NO: 132 |
| LILRB1 transmembrane domain | VVIGILVAVILLLLLLLLFLIL<br>SEQ ID NO: 133 |
| LILRB1 intracellular domain | RHRRQGKHWTSTQRKADFQHPAGAVGPEPTDRGLQWRS SPAADAQEENLYAAVKHTQPEDGVEMDTRSPHDEDPQAV TYAEVKHSRPRREMASPPSPLSGEFLDTKDRQAEEDRQM DTEAAASEAPQDVTYAQLHSLTLRREATEPPPSQEGPSPA VPSIYATLAIH<br>SEQ ID NO: 129 |
| ITIM1 | NLYAAV<br>SEQ ID NO: 115 |
| ITIM2 | VTYAEV<br>SEQ ID NO: 116 |
| ITIM3 | VTYAQL<br>SEQ ID NO: 117 |
| ITIM4 | SIYATL<br>SEQ ID NO: 118 |
| ITIM1-2 | NLYAAVKHTQPEDGVEMDTRSPHDEDPQAVTYAEV<br>SEQ ID NO: 119 |
| ITIM2-3 | VTYAEVKHSRPRREMASPPSPLSGEFLDTKDRQAEEDRQ MDTEAAASEAPQDVTYAQL<br>SEQ ID NO: 120 |
| ITIM3-4 | VTYAQLHSLTLRREATEPPPSQEGPSPAVPSIYATL<br>SEQ ID NO: 121 |

TABLE 6-continued

Polypeptide sequences for
illustrative LILRB1-based inhibitory receptors

| Name | Sequence |
| --- | --- |
| ITIM1-3 | NLYAAVKHTQPEDGVEMDTRSPHDEDPQAVTYAEVKHS<br>RPRREMASPPSPLSGEFLDTKDRQAEEDRQMDTEAAASEA<br>PQDVTYAQL<br>SEQ ID NO: 122 |
| ITIM2-4 | VTYAEVKHSRPRREMASPPSPLSGEFLDTKDRQAEEDRQ<br>MDTEAAASEAPQDVTYAQLHSLTLRREATEPPPSQEGPSP<br>AVPSIYATL<br>SEQ ID NO: 123 |
| ITIM1-4 | NLYAAVKHTQPEDGVEMDTRSPHDEDPQAVTYAEVKHS<br>RPRREMASPPSPLSGEFLDTKDRQAEEDRQMDTEAAASEA<br>PQDVTYAQLHSLTLRREATEPPPSQEGPSPAVPSIYATL<br>SEQ ID NO: 124 |
| D3D4 domain | YGSQSSKPYLLTHPSDPLEL<br>SEQ ID NO: 125 |
| Short hinge | VVSGPSGGPSSPTTGPTSTSGPEDQPLTPTGSDPQSGLGRH<br>LG<br>SEQ ID NO: 126 |
| Hinge<br>(iTIM hinge) | YGSQSSKPYLLTHPSDPLELVVSGPSGGPSSPTTGPTSTSGP<br>EDQPLTPTGSDPQSGLGRHLGV (SEQ ID NO: 424) |
| Short hinge 2 | VVSGPSGGPSSPTTGPTSTSGPEDQPLTPTGSDPQSGLGRH<br>LGV (SEQ ID NO: 425) |
| Long hinge 1 | AGSGGSGGSGGSPVPSTPPTPSPSTPPTPSPSGGSGNSSGSG<br>GSPVPSTPPTPSPSTPPTPSPSASV (SEQ ID NO: 426) |
| Long hinge 2 | AGSGGSGGSGGSPVPSTPPTNSSSTPPTPSPSPVPSTPPTNSS<br>STPPTPSPSPVPSTPPTNSSSTPPTPSPSASV (SEQ ID NO: 427) |
| 2x short hinge | VVSGPSGGPSSPTTGPTSTSGPEDQPLTPTGSDPQSGLGRH<br>VVSGPSGGPSSPTTGPTSTSGPEDQPLTPTGSDPQSGLGRH<br>LGV (SEQ ID NO: 428) |
| Hinge<br>(truncated) | TTGPTSTSGPEDQPLTPTGSDPQSGLGRHLGV (SEQ ID NO: 429) |
| Hinge-<br>transmembrane | YGSQSSKPYLLTHPSDPLELVVSGPSGGPSSPTTGPTSTSG<br>PEDQPLTPTGSDPQSGLGRHLGVVIGILVAVILLLLLLLL<br>FLIL<br>SEQ ID NO: 127 |
| Transmembrane-<br>intracellular<br>domain. | VVIGILVAVILLLLLLLLLFLILRHRRQGKHWTSTQRKA<br>DFQHPAGAVGPEPTDRGLQWRSSPAADAQEENLYAAVK<br>HTQPEDGVEMDTRSPHDEDPQAVTYAEVKHSRPRREMAS<br>PPSPLSGEFLDTKDRQAEEDRQMDTEAAASEAPQDVTYA<br>QLHSLTLRREATEPPPSQEGPSPAVPSIYATLAIH<br>SEQ ID NO: 128 |

Polynucleotides and Vectors

The disclosure provides polynucleotides or polynucleotide systems comprising a sequence encoding the sequence(s) of the first and second receptors of the disclosure. In some embodiments, the polynucleotides or polynucleotide systems further comprise an shRNA described herein. The disclosure provides vectors comprising the polynucleotides or polynucleotide systems described herein. The disclosure provides immune cells comprising the polynucleotides and vectors described herein.

In some embodiments, the polynucleotide or polynucleotide system comprises SEQ ID NO: 180, or a sequence that shares at least 80%, at least 85%, at least 90%, at least 95%, or at least 98% identity thereto. In some embodiments, the polynucleotide or polynucleotide system comprises SEQ ID NO: 181, or a sequence that shares at least 80%, at least 85%, at least 90%, at least 95%, or at least 98% identity thereto. In some embodiments, the polynucleotide or polynucleotide system comprises SEQ ID NO: 182, or a sequence that shares at least 80%, at least 85%, at least 90%, at least 95%, or at least 98% identity thereto. In some embodiments, the polynucleotide or polynucleotide system comprises SEQ ID NO: 183, or a sequence that shares at least 80%, at least 85%, at least 90%, at least 95%, or at least 98% identity thereto. In some embodiments, the polynucleotide or polynucleotide system comprises SEQ ID NO: 184, or a sequence that shares at least 80%, at least 85%, at least 90%, at least 95%, or at least 98% identity thereto.

In some embodiments, the polynucleotide or polynucleotide system comprises SEQ ID NO: 185, or a sequence that shares at least 80%, at least 85%, at least 90%, at least 95%, or at least 98% identity thereto. In some embodiments, the polynucleotide or polynucleotide system comprises SEQ ID NO: 187, or a sequence that shares at least 80%, at least 85%, at least 90%, at least 95%, or at least 98% identity thereto. In some embodiments, the polynucleotide or polynucleotide system comprises SEQ ID NO: 189, or a sequence that shares at least 80%, at least 85%, at least 90%, at least 95%, or at least 98% identity thereto. In some embodiments, the polynucleotide or polynucleotide system comprises SEQ ID NO: 191, or a sequence that shares at least 80%, at least 85%, at least 90%, at least 95%, or at least 98% identity thereto. In some embodiments, the polynucleotide or polynucleotide system comprises SEQ ID NO: 193, or a sequence that shares at least 80%, at least 85%, at least 90%, at least 95%, or at least 98% identity thereto.

In some embodiments, the sequence of the first and/or second receptor is operably linked to a promoter. In some embodiments, the sequence encoding the first receptor is operably linked to a first promoter, and the sequence encoding the second receptor is operably linked to a second promoter.

The disclosure provides vectors comprising the polynucleotides described herein.

In some embodiments, the first receptor is encoded by a first vector and the second receptor is encoded by second vector. In some embodiments, both receptors are encoded by a single vector.

In some embodiments, the first and second receptors are encoded by a single vector. Methods of encoding multiple polypeptides using a single vector will be known to persons of ordinary skill in the art, and include, inter alia, encoding multiple polypeptides under control of different promoters, or, if a single promoter is used to control transcription of multiple polypeptides, use of sequences encoding internal ribosome entry sites (IRES) and/or self-cleaving peptides. Exemplary self-cleaving peptides include T2A, P2A, E2A and F2A self-cleaving peptides. In some embodiments, the T2A self-cleaving peptide comprises a sequence of EGRGSLLTCGDVEENPGP (SEQ ID NO: 430). In some embodiments, the P2A self-cleaving peptide comprises a sequence of ATNFSLLKQAGDVEENPGP (SEQ ID NO: 431). In some embodiments, the E2A self-cleaving peptide comprises a sequence of QCTNYALLKLAGDVESNPGP (SEQ ID NO: 432). In some embodiments, the F2A self-cleaving peptide comprises a sequence of VKQTLNFDLLKLAGDVESNPGP (SEQ ID NO: 433). In some embodiments, the T2A self-cleaving peptide comprises a sequence of EGRGSLLTCGDVEENPGP (SEQ ID NO: 430). Any of the foregoing can also include an N terminal GSG linker. For example, a T2A self-cleaving peptide can also comprise a sequence of GSGEGRGSLLTCGDVEENPGP (SEQ ID NO: 178), which can be encoded by a sequence of GGATCCGGAGAGGGCAGAGGCAGCCTGCTGACATGTGGCGACGTGGAAGAGAACC CTGGCCCC (SEQ ID NO: 434).

In some embodiments, the vector comprises SEQ ID NO: 180, or a sequence that shares at least 80%, at least 85%, at least 90%, at least 95%, or at least 98% identity thereto. In some embodiments, the vector comprises SEQ ID NO: 181, or a sequence that shares at least 80%, at least 85%, at least 90%, at least 95%, or at least 98% identity thereto. In some embodiments, the vector comprises SEQ ID NO: 182, or a sequence that shares at least 80%, at least 85%, at least 90%, at least 95%, or at least 98% identity thereto. In some embodiments, the vector comprises SEQ ID NO: 183, or a sequence that shares at least 80%, at least 85%, at least 90%, at least 95%, or at least 98% identity thereto. In some embodiments, the vector comprises SEQ ID NO: 184, or a sequence that shares at least 80%, at least 85%, at least 90%, at least 95%, or at least 98% identity thereto.

In some embodiments, the vector comprises SEQ ID NO: 185, or a sequence that shares at least 80%, at least 85%, at least 90%, at least 95%, or at least 98% identity thereto. In some embodiments, the vector comprises SEQ ID NO: 187, or a sequence that shares at least 80%, at least 85%, at least 90%, at least 95%, or at least 98% identity thereto. In some embodiments, the vector comprises SEQ ID NO: 189, or a sequence that shares at least 80%, at least 85%, at least 90%, at least 95%, or at least 98% identity thereto. In some embodiments, the vector comprises SEQ ID NO: 191, or a sequence that shares at least 80%, at least 85%, at least 90%, at least 95%, or at least 98% identity thereto. In some embodiments, the vector comprises SEQ ID NO: 193, or a sequence that shares at least 80%, at least 85%, at least 90%, at least 95%, or at least 98% identity thereto.

In some embodiments, the vector encodes a polypeptide sequence comprising SEQ ID NO: 186, or a sequence that shares at least 80%, at least 85%, at least 90%, at least 95%, or at least 98% identity thereto. In some embodiments, the vector encodes a polypeptide sequence comprising SEQ ID NO: 188, or a sequence that shares at least 80%, at least 85%, at least 90%, at least 95%, or at least 98% identity thereto. In some embodiments, the vector encodes a polypeptide sequence comprising SEQ ID NO: 190, or a sequence that shares at least 80%, at least 85%, at least 90%, at least 95%, or at least 98% identity thereto. In some embodiments, the vector encodes a polypeptide sequence comprising SEQ ID NO: 192, or a sequence that shares at least 80%, at least 85%, at least 90%, at least 95%, or at least 98% identity thereto. In some embodiments, the vector encodes a polypeptide sequence comprising SEQ ID NO: 194, or a sequence that shares at least 80%, at least 85%, at least 90%, at least 95%, or at least 98% identity thereto.

In some embodiments, the vector is an expression vector, i.e. for the expression of the first and/or second receptor in a suitable cell.

Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

The expression of natural or synthetic nucleic acids encoding receptors is typically achieved by operably linking a nucleic acid encoding the receptor or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The polynucleotides encoding the receptors can be cloned into a number of types of vectors. For example, the polynucleotides can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to cells, such as immune cells, in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 basepairs (bp) upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, U6 promoter, as well as human gene promoters such as, but not limited to, the actin promoter, the myosin promoter, the hemoglobin promoter, and the creatine kinase promoter. Further, the disclosure should not be limited to the use of constitutive promoters. Inducible promoters are also contemplated as part of the disclosure. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In order to assess the expression of a receptor, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected or transduced cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York). One method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present disclosure, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots)

or by assays described herein to identify agents falling within the scope of the disclosure.

Immune Cells

The disclosure provides immune cells comprising the receptors, vectors and polynucleotides described herein.

In some embodiments, the immune cells comprise: (a) first receptor, comprising a first extracellular ligand binding domain specific to a target antigen selected from: (i) a cancer cell-specific antigen, or a peptide antigen thereof in a complex with a major histocompatibility complex class I (MHC-I); or (ii) EGFR, or a peptide antigen thereof in a complex with a major histocompatibility complex class I (MHC-I); and (b) a second receptor, comprising a second extracellular ligand binding specific to a non-target antigen whose expression that has been lost from a cancer cell due to loss of heterozygosity or another mechanism. In some embodiments, the non-target antigen is selected from CXCL16, COLEC12 and APCDD1, HLA-A*01, HLA-A*02, HLA-A*03, HLA-A*11, HLA-B*07, HLA-C*07, or an antigen peptide thereof in a complex with a major histocompatibility complex class I (MHC-I). In some embodiments, the non-target antigen is HLA-A*02, or an allelic variant thereof. In some embodiments, the first receptor is a CAR or TCR. In some embodiments, the second receptor is an inhibitory receptor.

In some embodiments, the immune cell comprises an shRNA. In some embodiments, the shRNA reduces or eliminates expression of B2M. In some embodiments, the shRNA reduces or eliminates expression of HLA-A*02.

In some embodiments, the immune cell comprises a modification to an MHC Class I gene or a B2M gene. In some embodiments, the MHC Class I gene is HLA-A*02, or an allelic variant thereof. In some embodiments, the modification reduces or eliminates expression of the MHC Class I gene or the B2M gene.

In some embodiments, the immune cell comprises a polynucleotide or polynucleotide system described herein. In some embodiments, the polynucleotide or polynucleotide system comprises a sequence encoding a first receptor described herein. In some embodiments, the polynucleotide or polynucleotide system comprises a sequence encoding a second receptor described herein. In some embodiments, the polynucleotide or polynucleotide systems encodes an shRNA described herein. In some embodiments, the polynucleotide or polynucleotide system comprises a sequence encoding a first receptor described herein and a second receptor described herein. In some embodiments, the polynucleotide or polynucleotide system comprises a sequence encoding a first receptor described herein, a second receptor described herein, and an shRNA described herein.

As used herein, the term "immune cell" refers to a cell involved in the innate or adaptive (acquired) immune systems. Exemplary innate immune cells include phagocytic cells such as neutrophils, monocytes and macrophages, Natural Killer (NK) cells, polymorphonuclear leukocytes such as neutrophils eosinophils and basophils and mononuclear cells such as monocytes, macrophages and mast cells. Immune cells with roles in acquired immunity include lymphocytes such as T-cells and B-cells.

In some embodiments, the first receptor comprises SEQ ID NO: 177, or a sequence sharing at least 75%, at least 80%, at least 85%, at least 90%, at least 95%, or at least 98% identity thereto; and the second receptor comprises SEQ ID NO: 174 or a sequence sharing at least 75%, at least 80%, at least 85%, at least 90%, at least 95%, or at least 98% identity thereto. In some embodiments, the first receptor comprises SEQ ID NO: 177, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto. In some embodiments, the first receptor comprises SEQ ID NO: 175, or a sequence sharing at least 75%, at least 80%, at least 85%, at least 90%, at least 95%, or at least 98% identity thereto; and the second receptor comprises SEQ ID NO: 174, or a sequence sharing at least 75%, at least 80%, at least 85%, at least 90%, at least 95%, or at least 98% identity thereto. In some embodiments, the first receptor comprises SEQ ID NO: 175, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto. In some embodiments, the first receptor comprises SEQ ID NO: 176, or a sequence sharing at least 75%, at least 80%, at least 85%, at least 90%, at least 95%, or at least 98% identity thereto; and the second receptor comprises SEQ ID NO: 173, or a sequence sharing at least 75%, at least 80%, at least 85%, at least 90%, at least 95%, or at least 98% identity thereto. In some embodiments, the first receptor comprises SEQ ID NO: 176, or a sequence sharing at least 75%, at least 80%, at least 85%, at least 90%, at least 95%, or at least 98% identity thereto; and the second receptor comprises SEQ ID NO: 174, or a sequence sharing at least 75%, at least 80%, at least 85%, at least 90%, at least 95%, or at least 98% identity thereto.

In some embodiments, the immune cell further comprises a T2A self-cleaving peptide, wherein the T2A self-cleaving peptide comprises SEQ ID NO: 178, or a sequence sharing at least 75%, at least 80%, at least 85%, at least 90%, at least 95%, or at least 98% identity thereto.

In some embodiments, the immune cell further comprises an interfering RNA, wherein the interfering RNA comprises SEQ ID NO: 179, or a sequence sharing at least 75%, at least 80%, at least 85%, at least 90%, at least 95%, or at least 98% identity thereto.

As used herein, a "T-cell" refers to a type of lymphocyte that originates from a bone marrow precursor that develops in the thymus gland. There are several distinct types of T-cells which develop upon migration to the thymus, which include, helper CD4+ T-cells, cytotoxic CD8+ T cells, memory T cells, regulatory CD4+ T-cells, NK T cells, 76 T cells, Mucosal-associated invariant T (MAIT) cells, and stem memory T-cells. Different types of T-cells can be distinguished by the ordinarily skilled artisan based on their expression of markers. Methods of distinguishing between T-cell types will be readily apparent to the ordinarily skilled artisan.

In some embodiments, the immune cell is selected form the group consisting of T cells, B cells and Natural Killer (NK) cells. In some embodiments, the immune cell is a T cell. In some embodiments, the immune cell is a B cell. In some embodiments, the immune cell is a Natural Killer (NK) cell. In some embodiments, the immune cell is CD8−. In some embodiments, the immune cell is CD8+. In some embodiments, the immune cell is CD4+. In some embodiments, the immune cell is CD4−. In some embodiments, the immune cell is CD8−/CD4+. In some embodiments, the immune cell is CD8+CD4− T cell.

In some embodiments, the immune cell is a gamma delta (γδ) T cell. In some embodiments, the immune cell is an invariant T cell. In some embodiments, the immune cell is an invariant natural killer T cell (iNKT cell).

In some embodiments, the first receptor and the second receptor together specifically activate the immune cell in the presence of the target cell.

In some embodiments, the immune cell is non-natural. In some embodiments, the immune cell is isolated.

Methods transforming populations of immune cells, such as T cells, with the vectors of the instant disclosure will be readily apparent to the person of ordinary skill in the art. For example, CD3+ T cells can be isolated from PBMCs using a CD3+ T cell negative isolation kit (Miltenyi), according to manufacturer's instructions. T cells can be cultured at a density of $1\times10^{\wedge}6$ cells/mL in X-Vivo 15 media supplemented with 5% human A/B serum and 1% Pen/strep in the presence of CD3/28 Dynabeads (1:1 cell to bead ratio) and 300 Units/mL of IL-2 (Miltenyi). After 2 days, T cells can be transduced with viral vectors, such as lentiviral vectors using methods known in the art. In some embodiments, the viral vector is transduced at a multiplicity of infection (MOI) of 5. Cells can then be cultured in IL-2 or other cytokines such as combinations of IL-7/15/21 for an additional 5 days prior to enrichment. Methods of isolating and culturing other populations of immune cells, such as B cells, or other populations of T cells, will be readily apparent to the person of ordinary skill in the art. Although this method outlines a potential approach it should be noted that these methodologies are rapidly evolving. For example excellent viral transduction of peripheral blood mononuclear cells can be achieved after 5 days of growth to generate a >99% CD3+ highly transduced cell population.

Methods of activating and culturing populations of T cells comprising the TCRs, CARs, inhibitory receptors, receptors or vectors encoding same, will be readily apparent to the person of ordinary skill in the art.

Whether prior to or after genetic modification of T cells to express a TCR, the T cells can be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041, 10040846; and U.S. Pat. Appl. Pub. No. 2006/0121005.

In some embodiments, T cells of the instant disclosure are expanded and activated in vitro. Generally, the T cells of the instant disclosure are expanded in vitro by contact with a surface having attached thereto an agent that stimulates a CD3/TCR complex associated signal and a ligand that stimulates a co-stimulatory molecule on the surface of the T cells. In particular, T cell populations may be stimulated as described herein, such as by contact with an anti-CD3 antibody. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besangon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, the primary stimulatory signal and the co-stimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In some embodiments, the agent providing the co-stimulatory signal is bound to a cell surface and the agent providing the primary activation signal is in solution or coupled to a surface. In certain embodiments, both agents can be in solution. In another embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present disclosure.

In some embodiments, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the co-stimulatory signal is an anti-CD28 antibody or antigen-binding fragment thereof; and both agents are co-immobilized to the same bead in equivalent molecular amounts. In one embodiment, a 1:1 ratio of each antibody bound to the beads for CD4+ T cell expansion and T cell growth is used. In some embodiments, the ratio of CD3:CD28 antibody bound to the beads ranges from 100:1 to 1:100 and all integer values there between. In one aspect of the present disclosure, more anti-CD28 antibody is bound to the particles than anti-CD3 antibody, i.e., the ratio of CD3:CD28 is less than one. In certain embodiments of the disclosure, the ratio of anti CD28 antibody to anti CD3 antibody bound to the beads is greater than 2:1.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. In some embodiments, a ratio of 1:1 cells to beads is used. One of skill in the art will appreciate that a variety of other ratios may be suitable for use in the present disclosure. In particular, ratios will vary depending on particle size and on cell size and type.

In further embodiments of the present disclosure, the cells, such as T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached to contact the T cells. In one embodiment the cells (for example, CD4+ T cells) and beads (for example, DYNABEADS CD3/CD28 T paramagnetic beads at a ratio of 1:1) are combined in a buffer. Again, those of ordinary skill in the art can readily appreciate any cell concentration may be used. In certain embodiments, it may be desirable to significantly decrease the volume in which particles and cells are mixed together (i.e., increase the concentration of cells), to ensure maximum contact of cells and particles. For example, in one embodiment, a concentration of about 2 billion cells/ml is used. In another embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. In some embodiments, cells that are cultured at a density of $1 \times 10^6$ cells/mL are used.

In some embodiments, the mixture may be cultured for several hours (about 3 hours) to about 14 days or any hourly integer value in between. In another embodiment, the beads and T cells are cultured together for 2-3 days. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercapto-ethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. In some embodiments, the media comprises X-VIVO-15 media supplemented with 5% human A/B serum, 1% penicillin/streptomycin (pen/strep) and 300 Units/ml of IL-2 (Miltenyi).

The T cells are maintained under conditions necessary to support growth, for example, an appropriate temperature (e.g., 37° C.) and atmosphere (e.g., air plus 5% CO2).

In some embodiments, the T cells comprising TCRs, CARs and inhibitory receptors of the disclosure are autologous. Prior to expansion and genetic modification, a source of T cells is obtained from a subject. Immune cells such as T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain embodiments of the present disclosure, any number of T cell lines available in the art, may be used. In certain embodiments of the present disclosure, T cells can be obtained from a unit of blood collected from a subject using any number of techniques known to the skilled artisan, such as Ficoll™ separation.

In some embodiments, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the cells collected by apheresis may be washed to remove the plasma fraction and to place the cells in an appropriate buffer or media for subsequent processing steps. In some embodiments, the cells are washed with phosphate buffered saline (PBS). In alternative embodiments, the wash solution lacks calcium and may lack magnesium or may lack many if not all divalent cations. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca2+-free, Mg2+-free PBS, PlasmaLyte A, or other saline solution with or without buffer. Alternatively, the undesirable components of the apheresis sample may be removed and the cells directly resuspended in culture media.

In some embodiments, immune cells such as T cells are isolated from peripheral blood lymphocytes by lysing the red blood cells and depleting the monocytes, for example, by centrifugation through a PERCOLL™ gradient or by counterflow centrifugal elutriation. Specific subpopulations of immune cells, such as T cells, B cells, or CD4+ T cells can be further isolated by positive or negative selection techniques. For example, in one embodiment, T cells are isolated by incubation with anti-CD4-conjugated beads, for a time period sufficient for positive selection of the desired T cells.

Enrichment of an immune cell population, such as a T cell population, by negative selection can be accomplished with a combination of antibodies directed to surface markers unique to the negatively selected cells. One method is cell sorting and/or selection via negative magnetic immune-adherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD 14, CD20, CD 11b, CD 16, HLA-DR, and CD8.

For isolation of a desired population of immune cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads.

In some embodiments, the cells may be incubated on a rotator for varying lengths of time at varying speeds at either 2-10° C. or at room temperature.

T cells for stimulation, or PBMCs from which immune cells such as T cells are isolated, can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

The disclosure provides an immune cell expressing the activator and/or inhibitory receptors described herein, wherein the immune cell has reduced expression and/or function the major histocompatibility (MHC) class I complex.

In some embodiments, the immune cell is autologous. For example, the immune cells is isolated or derived from same subject who will receive the cell as part of a therapeutic regimen. It can be advantageous to modify autologous immune cells to have reduced expression and/or function of MHC class I with the inhibitory receptor is specific to an MHC class I antigen. Without wishing to be bound by theory, modification of autologous immune cells to have reduced expression and/or function of MHC class I reduces binding of the inhibitory receptor by MHC class I expressed by the immune cells, either in cis or in trans.

In some embodiments, the immune cell is all allogeneic. Allogeneic immune cells can be derived from a donor other than the subject to which the immune cells will be administered. Allogeneic immune cells have been commonly referred to in cell therapy as "off-the-shelf" or "universal" because of the possibility for allogeneic cells to be prepared and stored for use in subjects of a variety of genotypes.

Any suitable methods of reducing expression and/or function the MHC class I complex are envisaged as within the scope of the instant disclosure, and include, inter alia, expression of interfering RNAs that knock down one or more RNAs encoding MHC class I components, or modifications of genes encoding MHC class I components.

The major histocompatibility complex (MHC) is a locus on the vertebrate genome that encodes a set of polypeptides required for the adaptive immune system. Among these are MHC class I polypeptides that include HLA-A, HLA-B, and HLA-C and alleles thereof. MHC class I alleles are highly polymorphic and expressed in all nucleated cells. MHC class I polypeptides encoded by HLA-A, HLA-B, and HLA-C and alleles thereof form heterodimers with J2 microglobulin (B2M) and present in complex with antigens on the surface of cells. As referred to herein, an MHC class I gene or polypeptide may refer to any polypeptide found in the the MHC or the corresponding gene encoding said polypeptide. In some embodiments, the immune cells of the disclosure are inactivated by an inhibitor ligand comprising an MHC class I polypeptide, e.g. HLA-A, HLA-B, and HLA-C and alleles thereof. HLA-A alleles can be, for example and without limitation, HLA-A*02, HLA-A*02:01, HLA-A*02:01:01, HLA-A*02:01:01:01, and/or any gene that encodes protein identical or similar to HLA-A*02 protein. Thus, to prevent autocrine signaling/binding as described herein, it is desirable to eliminate or reduce expression of polypeptides encoded by HLA-A, HLA-B, and HLA-C and alleles thereof in the immune cells.

Immune Cells with Reduced MHC Class I Polypeptide Expression

In some embodiments, the immune cells described herein are modified to inactivate, or reduce or eliminate expression or function of an endogenous gene encoding an allele of an endogenous MHC class I polypeptide. In some embodiments, the gene encoding the MHC class I polypeptide is HLA-A, HLA-B, and/or HLA-C. HLA-A, HLA-B and HLA-C are encoded by the HLA-A, HLA-B and HLA-C loci. Each of HLA-A, HLA-B and HLA-C includes many variant alleles, all of which are envisaged as within the scope of the instant disclosure. In some embodiments, the gene encoding the MHC class I polypeptide is HLA-A. In some embodiments, the gene encoding the MHC class I polypeptide is HLA-A*02. In some embodiments, the gene encoding the MHC class I polypeptide is HLA-A*02:01. In some embodiments, the gene encoding the MHC class I polypeptide is HLA-A*02:01:01. In some embodiments, the gene encoding the MHC class I polypeptide is HLA-A*02:01:01:01.

In some embodiments, the genetically engineered immune cells described herein are modified to reduce or eliminate expression of the B2M gene product. The beta-2 microglobulin (B2M) gene encodes a protein that associates with the major histocompatibility complex (MHC) class I, i.e. MHC-I complex. The MHC-I complex is required for presentation of antigens on the cell surface. The MHC-I complex is disrupted and non-functional when the B2M is deleted (Wang D et al. Stem Cells Transl Med. 4:1234-1245 (2015)). Furthermore, the B2M gene can be disrupted with high efficiency using gene editing techniques known in the art (Ren et al. Clin. Cancer Res. 23:2255-2266 (2017)). Reducing or eliminating B2M can reduce, or eliminate functional MHC I on the surface of the immune cell.

The disclosure provides gene editing systems for editing an endogenous target gene in an immune cell. The disclosure provides interfering RNAs specific to sequences of target genes. Gene editing systems such as CRISPR/Cas systems, TALENs and zinc fingers can be used to generate double strand breaks, which, through gene repair mechanisms such as homology directed repair or non-homologous end joining (NHEJ), can be used to introduce mutations. NHEJ after resection of the ends of the break, or improper end joining, can be used to introduce deletions. In some embodiments, the target gene comprises a gene encoding a subunit of the MIC-I complex.

Target gene sequences include, but are not limited to, promoters, enhancers, introns, exons, intron/exon junctions, transcription products (pre-mRNA, mRNA, and splice variants), and/or 3' and 5' untranslated regions (UTRs). Any gene element or combination of gene elements may be targeted for the purpose of genetic editing in the immune cells described herein. Modifications to the target genes can be accomplished using any method known in the art to edit the target gene that results in altered or disrupted expression or function the target gene or gene product.

In some embodiments, modifying the gene encoding the MHC class I polypeptide comprises deleting all or a portion of the gene. In some embodiments, modifying the gene encoding the MHC class I polypeptide comprises introducing a mutation in the gene. In some embodiments, the mutation comprises a deletion, insertion, substitution, or frameshift mutation. In some embodiments, modifying the gene comprises using a nucleic acid guided endonuclease.

Gene sequences for the target genes described herein are known in the art. The sequences can be found at public databases, such as NCBI GenBank or the NCBI nucleotide database. Sequences may be found using gene identifiers, for example, the HLA-A gene has NCBI Gene ID: 3105, the HLA-B gene has NCBI Gene ID: 3106, the HLA-C gene has NCBI Gene ID: 3107, and the B2M gene has NCBI Gene ID: 567 and NCBI Reference Sequence: NC_000015.10. Gene sequences may also be found by searching public databases using keywords. For example, HLA-A alleles may be found in the NCBI nucleotide database by searching keywords, "HLA-A*02", "HLA-A*02:01", "HLA-A*02:01:01", or "HLA-A*02:01:01:01." These sequences can be used for targeting in various gene editing techniques known in the art. Table 7 provides non-limiting illustrative sequences of HLA-A allele and B2M gene sequences targeted for modification as described herein.

TABLE 7

| Exemplary Target Gene Sequences | |
|---|---|
| B2M mRNA | AUUCCUGAAGCUGACAGCAUUCGGGCCGAGAUGUCUCGCUCCGUGGCCUUAGCUGUGCUCGCGCU<br>ACUCUCUCUUUCUGGCCUGGAGGCUAUCCAGCGUACUCCAAAGAUUCAGGUUUACUCACGUCAUC<br>CAGCAGAGAAUGGAAAGUCAAAUUUCCUGAAUUGCUAUGUGUCUGGGUUUCAUCCAUCCGACAUU<br>GAAGUUGACUUACUGAAGAAUGGAGAGAGAAUUGAAAAAGUGGAGCAUUCAGACUUGUCUUUCAG<br>CAAGGACUGGUCUUUCUAUCUCUUGUACUACACUGAAUUCACCCCCACUGAAAAAGAUGAGUAUG<br>CCUGCCGUGUGAACCAUGUGACUUUGUCACAGCCCAAGAUAGUUAAGUGGGAUCGAGACAUGUAA<br>GCAGCAUCAUGGAGGUUUGAAGAUGCCGCAUUUGGAUUGGAUGAAUUCCAAAUUCUGCUUGCUUG<br>CUUUUUAAUAUUGAUAUGCUUAUACACUUACACUUUAUGCACAAAAUGUAGGGUUAUAAUAAUGU<br>UAACAUGGACAUGAUCUUCUUUAUAAUUCUACUUUGAGUGCUGUCUCCAUGUUUGAUGUAUCUGA<br>GCAGGUUGCUCCACAGGUAGCUCUAGGAGGGCUGGCAACUUAGAGGUGGGGAGCAGAGAAUUCUC<br>UUAUCCAACAUCAACAUCUUGGUCAGAUUUGAACUCUUCAAUCUCUUGCACUCAAAGCUUGUUAA<br>GAUAGUUAAGCGUGCAUAAGUUAACUUCCAAUUUACAUACUCUGCUUUAGAAUUUGGGGGAAAAUU<br>UAGAAAUAUAAUUGACAGGAUUAUUGGAAAUUUGUUAUAAUGAAUGAAACAUUUUGUCAUAUAAG<br>AUUCAUAUUUACUUCUUAUACAUUUGAUAAAGUAAGGCAUGGUUGUGGGUUAAUCUGGUUUAUUUU<br>UGUUCCACAAGUUAAAUAAAUCAUAAAACUUGA (SEQ ID NO: 172) |
| B2M Gene<br>(GenBank:<br>567) | AAGTGGAGGCGTCGCGCTGGCGGGCATTCCTGAAGCTGACAGCATTCGGGCCGAGAT<br>GTCTCGCTCCGTGGCCTTAGCTGTGCTCGCGCTACTCTCTCTTTCTGGCCTGGAGGCTA<br>TCCAGCGTGAGTCTCTCCTACCCTCCCGCTCTGGTCCTTCCTCTCCCGCTCTGCACCCT<br>CTGTGGCCCTCGCTGTGCTCTCTCGCTCCGTGACTTCCCTTCTCCAAGTTCTCCTTGGT<br>GGCCCGCCGTGGGGCTAGTCCAGGGCTGGATCTCGGGGAAGCGGCGGGGTGGCCTG<br>GGAGTGGGGAAGGGGGTGCGCACCCGGGACGCGCGCTACTTGCCCCTTTCGGCGGGG<br>AGCAGGGGAGACCTTTGGCCTACGGCGACGGGAGGGTCGGGACAAAGTTTAGGGCG<br>TCGATAAGCGTCAGAGCGCCGAGGTTGGGGGAGGGTTTCTCTTCCGCTCTTTCGCGG<br>GGCCTCTGGCTCCCCCAGCGCAGCTGGAGTGGGGGACGGGTAGGCTCGTCCCAAAGG<br>CGCGGCGCTGAGGTTTGTGAACGCGTGGAGGGGCGCTTGGGGTCTGGGGGAGGCGTC<br>GCCCGGGTAAGCCTGTCTGCTGCGGCTCTGCTTCCCTTAGACTTGGAGAGCTGTGGACT<br>TCGTCTAGGCGCCCGCTAAGTTCGCATGTCCTAGCACCTCTGGGTCTATGTGGGGCCA<br>CACCGTGGGGAGGAAACAGCACGCGACGTTTGTAGAATGCTTGGCTGTGATACAAAG<br>CGGTTTCGAATAATTAACTTATTTGTTCCCATCACATGTCACTTTTAAAAAATTATAA<br>GAACTACCCGTTATTGACATCTTTCTGTGTGCCAAGGACTTTATGTGCTTTGCGTCATT<br>TAATTTTGAAAACAGTTATCTTCCGCCATAGATAACTACTATGGTTATCTTCTGCCTCT<br>CACAGATGAAGAAACTAAGGCACCGAGATTTTAAGAAACTTAATTACACAGGGGAT<br>AAATGGCAGCAATCGAGATTGAAGTCAAGCCTAACCAGGGCTTTTGCGGGAGCGCAT<br>GCCTTTTGGCTGTAATTCGTGCATTTTTTTTAAGAAAAACGCCTGCCTTCTGCGTGAG<br>ATTCTCCAGAGCAAACTGGGCGGCATGGGCCCTGTGGTCTTTTCGTACAGAGGGCTTC<br>CTCTTTGGCTCTTTGCCTGGTTGTTTCCAAGATGTACTGTGCCTCTTACTTTCGGTTTT<br>GAAAACATGAGGGGGTTGGGCGTGGTAGCTTACGCCTGTAATCCCAGCACTTAGGGA<br>GGCCGAGGCGGGAGGATGGCTTGAGGTCCGTAGTTGAGACCAGCCTGGCCAACATG<br>GTGAAGCCTGGTCTCTACAAAAAATAATAACAAAATTAGCCGGGTGTGGTGGCTCG<br>TGCCTGTGGTCCCAGCTGCTCCGGTGGCTGAGGCGGGAGGATCTCTTGAGCTTAGGCT<br>TTTGAGCTATCATGGCGCCAGTGCACTCCAGCGTGGGCAACAGAGCGAGACCCTGTC<br>TCTCAAAAAGAAAAAAAAAAAAAAGAAAGAGAAAAGAAAAGAAAGAAGT<br>GAAGGTTTGTCAGTCAGGGGAGCTGTAAAACCATTAATAAAGATAATCCAAGATGGT<br>TACCAAGACTGTTGAGGACGCCAGAGATCTTGAGCACTTTCTAAGTACCTGGCAATA<br>CACTAAGCGCGCTCACCTTTTCCTCTGGCAAAACATGATCGAAAGCAGAATGTTTTGA<br>TCATGAGAAAATTGCATTTAATTTGAATACAATTTATTTACAACATAAAGGATAATGT<br>ATATATCACCACCATTACTGGTATTTGCTGGTTATGTTAGATGTCATTTTAAAAAATA<br>ACAATCTGATATTTAAAAAAAAATCTTATTTTGAAAATTTCCAAAGTAATACATGCCA<br>TGCATAGACCATTTCTGGAAGATACCACAAGAAACATGTAATGATGATTGCCTCTGA<br>AGGTCTATTTTCCTCCTCTGACCTGTGTGTGGGTTTTGTTTTTGTTTTACTGTGGGCAT<br>AAATTAATTTTTCAGTTAAGTTTTGGAAGCTTAAATAACTCTCCAAAAGTCATAAAGC<br>CAGTAACTGGTTGAGCCCAAATTCAAACCCAGCCTGTCTGATACTTGTCCTCTTCTTA<br>GAAAAGATTACAGTGATGCTCTCACAAAATCTTGCCGCCTTCCCTCAAACAGAGAGT<br>TCCAGGCAGGATGAATCTGTGCTCTGATCCCTGAGGCATTTAATATGTTCTTATTATT<br>AGAAGCTCAGATGCAAAGAGCTCTCTTAGCTTTTAATGTTATGAAAAAAATCAGGTC<br>TTCATTAGATTCCCCAATCCACCTCTTGATGGGGCTAGTAGCCTTTCCTTAATGATAG<br>GGTGTTTCTAGAGAGATATATCTGGTCAAGGTGGCCTGGTACTCCTCCTTCTCCCCAC<br>AGCCTCCCAGACAAGGAGGAGTAGCTGCCTTTTAGTGATCATGTACCCTGAATATAA<br>GTGTATTTAAAAGAATTTTATACACATATATTTAGTGTCAATCTGTATATTTAGTAGC<br>ACTAACACTTCTCTTCATTTTCAATGAAAAATATAGAGTTTATAATATTTTCTTCCCAC<br>TTCCCCATGGATGGTCTAGTCATGCCTCTCATTTTGGAAAGTACTGTTTCTGAAACAT<br>TAGGCAATATATTCCCAACCTGGCTAGTTTACAGCAATCACCTGTGGATGCTAATTAA<br>AACGCAAATCCCACTGTCACATGCATTACTCCATTTGATCATAATGGAAAGTATGTTC<br>TGTCCCATTTGCCATAGTCCTCACCTATCCCTGTTGTATTTTATCGGGTCCAACTCAC<br>CATTTAAGGTATTTGCCAGCTCTTGTATGCATTTAGGTTTTGTTTCTTTGTTTTTTAGCT<br>CATGAAATTAGGTACAAAGTCAGAGAGGGGTCTGGCATATAAAACCTCAGCAGAAA<br>TAAAAGAGGTTTTGTTGTTTGGTAAGAACATACCTTGGGTTGGTTGGGCACGGTGGCTC<br>GTGCCTGTAATCCCAACACTTTGGGAGGCCAAGGCAGGCTGATCACTTGAAGTTGGG<br>AGTTCAAGACCAGCCTGGCCAACATGGTGAAATCCCGTCTCTACTGAAAATACAAAA<br>ATTAACCAGGCATGGTGGTGTGTGCCTGTAGTCCCAGGAATCACTTGAACCCAGGAG<br>GCGGAGGTTGCAGTGAGCTGAGATCTCACCACTGCACACTGCACTCCAGCCTGGGCA<br>ATGGAATGAGATTCCATCCCAAAAAATAAAAAATAAAAAAATAAAGAACATACCT<br>TGGGTTGATCCACTTAGGAACCTCAGATAATAACATCTGCCACGTATAGAGCAATTG<br>CTATGTCCCAGGCACTCTACTAGACACTTCATCAGTTTAGAAAATCAGATGGGTGTA<br>GATCAAGGCAGGAGCAGGAACCAAAAAGAAAGGCATAAACATAAGAAAAAAAATG<br>GAAGGGGTGGAAACAGAGTACAATAACATGAGTAATTTGATGGGGGCTATTATGAA<br>CTGAGAAATGAACTTTGAAAAGTATCTTGGGGCCAAATCATGTAGACTCTTGAGTGA |

TABLE 7-continued

Exemplary Target Gene Sequences

| | |
|---|---|
| | TGTGTTAAGGAATGCTATGAGTGCTGAGAGGGCATCAGAAGTCCTTGAGAGCCTCCA<br>GAGAAAGGCTCTTAAAAATGCAGCGCAATCTCCAGTGACAGAAGATACTGCTAGAA<br>ATCTGCTAGAAAAAAAACAAAAAAGGCATGTATAGAGGAATTATGAGGGAAAGATA<br>CCAAGTCACGGTTTATTCTTCAAAATGGAGGTGGCTTGTTGGGAAGGTGGAAGCTCA<br>TTTGGCCAGAGTGGAAATGGAATTGGGAGAAATCGATGACCAAATGTAAACACTTGG<br>TGCCTGATATAGCTTGACACCAAGTTAGCCCCAAGTGAAATACCCTGGCAATATTAA<br>TGTGTCTTTTCCCGATATTCCTCAGGTACTCCAAAGATTCAGGTTTACTCACGTCATCC<br>AGCAGAGAATGGAAAGTCAAATTTCCTGAATTGCTATGTGTCTGGGTTTCATCCATCC<br>GACATTGAAGTTGACTTACTGAAGAATGGAGAGAGAATTGAAAAAGTGGAGCATTC<br>AGACTTGTCTTTCAGCAAGGACTGGTCTTTCTATCTCTTGTACTACACTGAATTCACCC<br>CCACTGAAAAAGATGAGTATGCCTGCCGTGTGAACCATGTGACTTTGTCACAGCCCA<br>AGATAGTTAAGTGGGGTAAGTCTTACATTCTTTTGTAAGCTGCTGAAAGTTGTGTATG<br>AGTAGTCATATCATAAAGCTGCTTTGATATAAAAAAGGTCTATGGCCATACTACCCTG<br>AATGAGTCCCATCCCATCTGATATAAACAATCTGCATATTGGGATTGTCAGGGAATGT<br>TCTTAAAGATCAGATTAGTGGCACCTGCTGAGATACTGATGCACAGCATGGTTTCTGA<br>ACCAGTAGTTTCCCTGCAGTTGAGCAGGGAGCAGCAGCAGCACTTGCACAAATACAT<br>ATACACTCTTAACACTTCTTACCTACTGGCTTCCTCTAGCTTTTGTGGCAGCTTCAGGT<br>ATATTTAGCACTGAACGAACATCTCAAGAAGGTATAGGCCTTTGTTTGTAAGTCCTGC<br>TGTCCTAGCATCCTATAATCCTGGACTTCTCCAGTACTTTTCTGGCTGGATTGGTATCTG<br>AGGCTAGTAGGAAGGGCTTGTTCCTGCTGGGTAGCTCTAAACAATGTATTCATGGGT<br>AGGAACAGCAGCCTATTCTGCCAGCCTTATTTCTAACCATTTTAGACATTTGTTAGTA<br>CATGGTATTTTAAAAGTAAAACTTAATGTCTTCCTTTTTTTTCTCCACTGTCTTTTTCAT<br>AGATCGAGACATGTAAGCAGCATCATGGAGGTAAGTTTTTGACCTTGAGAAAATGTT<br>TTTGTTTCACTGTCCTGAGGACTATTTATAGACAGCTCTAACATGATAACCCTCACTA<br>TGTGGAGAACATTGACAGAGTAACATTTTAGCAGGGAAAGAAGAATCCTACAGGGTC<br>ATGTTCCCTTCTCCTGTGGAGTGGCATGAAGAAGGTGTATGGCCCCAGGTATGGCCAT<br>ATTACTGACCCTCTACAGAGAGGGCAAAGGAACTGCCAGTATGGTATTGCAGGATAA<br>AGGCAGGTGGTTACCCACATTACCTGCAAGGCTTTGATCTTTCTTCTGCCATTTCCAC<br>ATTGGACATCTCTGCTGAGGAGAGAAAATGAACCACTCTTTTCCTTTGTATAATGTTG<br>TTTTATTCTTCAGACAGAAGAGAGGAGTTATACAGCTCTGCAGACATCCCATTCCTGT<br>ATGGGGACTGTGTTTGCCTCTTAGAGGTTCCCAGGCCACTAGAGGGAGATAAAGGGAA<br>ACAGATTGTTATAACTTGATATAATGATACTATAATAGATGTAACTACAAGGAGCTC<br>CAGAAGCAAGAGAGGGAGGAACTTGGACTTCTCTGCATCTTTAGTTGGAGTCCAA<br>AGGCTTTTCAATGAAATTCTACTGCCCAGGGTACATTGATGCTGAAACCCCATTCAAA<br>TCTCCTGTTATATTCTAGAACAGGGAATTGATTTGGGAGAGCATCAGGAAGGTGGAT<br>GATCTGCCCAGTCACACTGTTAGTAAATTGTAGAGCCAGGACCTGAACTCTAATATA<br>GTCATGTGTTACTTAATGACGGGACATGTTCTGAGAAATGCTTACACAAACCTAGG<br>TGTTGTAGCCTACTACACGCATAGGCTACATGGTATAGCCTATTGCTCCTAGACTACA<br>AACCTGTACAGCCTGTTACTGTACTGAATACTGTGGGCAGTTGTAACACAATGGTAA<br>GTATTTGTGTATCTAAACATAGAAGTTGCAGTAAAAATATGCTATTTTAATCTTATGA<br>GACCACTGTCATATATACAGTCCATCATTGACCAAAACATCATATCAGCATTTTTTCT<br>TCTAAGATTTTGGGAGCACCAAAGGGATACACTAACAGGATATACTCTTTATAATGG<br>GTTTGGAGAACTGTCTGCAGCTACTTCTTTTAAAAAGGTGATCTACACAGTAGAAATT<br>AGACAAGTTTGGTAATGAGATCTGCAATCCAAATAAAATAAATTCATTGCTAACCTTT<br>TTCTTTTCTTTTCAGGTTTGAAGATGCCGCATTTGGATTGGATGAATTCCAAATTCTGC<br>TTGCTTGCTTTTTAATATTGATATGCTTATACACTTACACTTTATGCACAAAATGTAGG<br>GTTATAATAATGTTAACATGGACATGATCTTCTTTATAATTCTACTTTGAGTGCTGTCT<br>CCATGTTTGATGTATCTGAGCAGGTTGCTCCACAGGTAGCTCTAGGAGGGCTGGCAA<br>CTTAGAGGTGGGGAGCAGAGAATTCTCTTATCCAACATCAACATCTTGGTCAGATTTG<br>AACTCTTCAATCTCTTGCACTCAAAGCTTGTTAAGATAGTTAAGCGTGCATAAGTTAA<br>CTTCCAATTTACATACTCTGCTTAGAATTTGGGGGAAAATTTAGAAATATAATTGACA<br>GGATTATTGGAAATTTGTTATAATGAATGAAACATTTTGTCATATAAGATTCATATTT<br>ACTTCTTATACATTTGATAAAGTAAGGCATGGTTGTGGTTAATCTGGTTTATTTTTGTT<br>CCACAAGTTAAATAAATCATAAAACTTGA (SEQ ID NO: 170) |
| HLA-<br>A*02:01:<br>01:01<br>sequence<br>encoding<br>mRNA | CAGAAGCAGAGGGGTCAGGGCGAAGTCCCAGGGCCCCAGGCGTGGCTCTCAGGGTCTCAGGCCCC<br>GAAGGCGGTGTATGGATTGGGGAGTCCCAGCCTTGGGGATTCCCCAACTCCGCAGTTTCTTTTCT<br>CCCTCTCCCAACCTATGTAGGGTCCTTCTTCCTGGATACTCACGACGCGGACCCAGTTCTCACTC<br>CCATTGGGTGTCGGGTTTCCAGAGAAGCCAATCAGTGTCGTCGCGGTCGCGGTTCTAAAGTCCGC<br>ACGCACCCACCGGGACTCAGATTCTCCCCAGACGCCGAGGATGGCCGTCATGGCGCCCGAACCC<br>TCGTCCTGCTACTCTCGGGGGCTCTGGCCCTGACCCAGACCTGGGCGGGCTCTCACTCCATGAGG<br>TATTTCTTCACATCCGTGTCCCGGCCCGGCCGCGGGGAGCCCCGCTTCATCGCAGTGGGCTACGT<br>GGACGACACGCAGTTCGTGCGGTTCGACAGCGACGCCGCGAGCCAGAGGATGGAGCCGCGGGCGC<br>CGTGGATAGAGCAGGAGGGTCCGGAGTATTGGGACGGGGAGACACGGAAAGTGAAGGCCCACTCA<br>CAGACTCACCGAGTGGACCTGGGGACCCTGCGCGGCTACTACAACCAGAGCGAGGCCGGTTCTCA<br>CACCGTCCAGAGGATGTATGGCTGCGACGTGGGGTCGGACTGGCGCTTCCTCCGCGGGTACCACC<br>AGTACGCCTACGACGGCAAGGATTACATCGCCCTGAAAGAGGACCTGCGCTCTTGGACCGCGGCG<br>GACATGGCAGCTCAGACCACCAAGCACAAGTGGGAGGCGGCCCATGTGGCGGAGCAGTTGAGAGC<br>CTACCTGGAGGGCACGTGCGTGGAGTGGCTCCGCAGATACCTGGAGAACGGGAAGGAGACGCTGC<br>AGCGCACGGACGCCCCCAAAACGCATATGACTCACCACGCTGTCTCTGACCATGAAGCCACCCTG<br>AGGTGCTGGGCCCTGAGCTTCTACCCTGCGGAGATCACACTGACCTGGCAGCGGGATGGGGAGGA<br>CCAGACCCAGGACACGGAGCTCGTGGAGACCAGGCCTGCAGGGGATGGAACCTTCCAGAAGTGGG<br>CGGCTGTGGTGGTGCCTTCTGGACAGGAGCAGAGATACACCTGCCATGTGCAGCATGAGGGTTTG<br>CCCAAGCCCCTCACCCTGAGATGGGAGCCGTCTTCCCAGCCCACCATCCCCATCGTGGGCATCAT<br>TGCTGGCCTGGTTCTCTTTGGAGCTGTGATCACTGGAGCTGTGGTCGCTGCTGTGATGTGGAGGA<br>GGAAGAGCTCAGATAGAAAAGGAGGGAGCTACTCTCAGGCTGCAAGCAGTGACAGTGCCCAGGGC<br>TCTGATGTGTCTCTCACAGCTTGTAAAGTGTGAGACAGCTGCCTTGTGTGGGACTGAGAGGCAAG<br>AGTTGTTCCTGCCCTTCCCTTTGTGACTTGAAGAACCCTGACTTTGTTTCTGCAAAGGCACCTGC |

TABLE 7-continued

Exemplary Target Gene Sequences

| | |
|---|---|
| | ATGTGTCTGTGTTCGTGTAGGCATAATGTGAGGAGGTGGGGAGACCACCCCACCCCCATGTCCAC<br>CATGACCCTCTTCCCACGCTGACCTGTGCTCCCTCCCCAATCATCTTTCCTGTTCCAGAGAGGTG<br>GGGCTGAGGTGTCTCCATCTCTGTCTCAACTTCATGGTGCACTGAGCTGTAACTTCTTCCTTCCC<br>TATTAAAA (SEQ ID NO: 171) |
| HLA-A*02<br>(GenBank:<br>LK021978.1) | ATGGCCGTCATGGCGCCCCGAACCCTCGTCCTGCTACTCTCGGGGGCTCTGGCCCTGA<br>CCCAGACCTGGGCGGGTGAGTGCGGGGTCGGGAGGGAAACGGCCTCTGTGGGGAGA<br>AGCAACGGGCCCGCCTGGCGGGGGCGCAGGACCCGGGAAGCCGCGCCGGGAGGAGG<br>GTCGGGCGGGTCTCAGCCACTCCTCGTCCCCAGGCTCTCACTCCATGAGGTATTTCTT<br>CACATCCGTGTCCCGGCCCGGCCGCGGGGAGCCCCGCTTCATCGCAGTGGGCTACGT<br>GGACGACACGCAGTTCGTGCGGTTCGACAGCGACGCCGCGAGCCAGAGGATGGAGC<br>CGCGGGCGCCGTGGATAGAGCAGGAGGGTCCGGAGTATTGGGACGGGGAGACACGG<br>AAAGTGAAGGCCCACTCACAGACTCACCGAGTGGACCTGGGGACCCTGCGCGGCTAC<br>TACAACCAGAGCGAGGCCGGTGAGTGACCCCGGCCCGGGGCGCAGGTCACGACCTCT<br>CATCCCCCACGGACGGGCCAGGTCGCCCACAGTCTCCGGGTCCGAGATCCGCCCCGA<br>AGCCGCGGGACCCCGAGACCCTTGCCCCGGGAGAGGCCCAGGCGCCTTTACCCGGTT<br>TCATTTTCAGTTTAGGCCAAAAATCCCCCCAGGTTGGTCGGGGCGGGGCGGGGCTCG<br>GGGGACCGGGCTGACCGCGGGGTCCGGGCCAGGTTCTCACACCGTCCAGAGGATGTA<br>TGGCTGCGACGTGGGGTCGGACTGGCGCTTCCTCCGCGGGTACCACCAGTACGCCTA<br>CGACGGCAAGGATTACATCGCCCTGAAAGAGGACCTGCGCTCTTTGACCGCGGCGGA<br>CATGGCAGCTCAGACCACCAAGCACAAGTGGGAGGCGGCCCATGTGGCGGAGCAGT<br>TGAGAGCCTACCTGGAGGGCACGTGCGTGGAGTGGCTCCGCAGATACCTGGAGAACG<br>GGAAGGAGACGCTGCAGCGCACGGGTACCAGGGGCCACGGGGCGCCTCCCTGATCG<br>CCTGTAGATCTCCCGGGCTGGCCTCCCACAAGGAGGGGAGACAATTGGGACCAACAC<br>TAGAATATCGCCCTCCCTCTGGTCCTGAGGGAGAGGAATCCTCCTGGGTTTCCAGATC<br>CTGTACCAGAGAGTGACTCTGAGGTTCCGCCCTGCTCTCTGACACAATTAAGGGATA<br>AAATCTCTGAAGGAATGACGGGAAGACGATCCCTCGAATACTGATGAGTGGTTCCCT<br>TTGACACACACAGGCAGCAGCCTTGGGCCCGTGACTTTTCCTCTCAGGCCTTGTTCTC<br>TGCTTCACACTCAATGTGTGTGGGGGTCTGAGTCCAGCACTTCTGAGTCCTTCAGCCT<br>CCACTCAGGTCAGGACCAGAAGTCGCTGTTCCCTCTTCAGGGACTAGAATTTTCCACG<br>GAATAGGAGATTATCCCAGGTGCCTGTGTCCAGGCTGGTGTCTGGGTTCTGTGCTCCC<br>TTCCCCATCCCAGGTGTCCTGTCCATTCTCAAGATAGCCACATGTGTGCTGGAGGAGT<br>GTCCCATGACAGATGCAAAATGCCTGAATGATCTGACTCTTCCTGACAGACGCCCCC<br>AAAACGCATATGACTCACCACGCTGTCTCTGACCATGAAGCCACCCTGAGGTGCTGG<br>GCCCTGAGCTTCTACCCTGCGGAGATCACACTGACCTGGCAGCGGGATGGGGAGGAC<br>CAGACCCAGGACACGGAGCTCGTGGAGACCCAGGCCTGCAGGGGATGGAACCTTCA<br>GAAGTGGGCGGCTGTGGTGGTGCCTTCTGGACAGGAGCAGAGATACACCTGCCATGT<br>GCAGCATGAGGGTTTGCCCAAGCCCCTCACCCTGAGATGGGGTAAGGAGGGAGACG<br>GGGGTGTCATGTCTTTTAGGGAAAGCAGGAGCCTCTCTGACCTTTAGCAGGGTCAGG<br>GCCCCTCACCTTCCCCTCTTTTCCCAGAGCCGTCTTCCCAGCCCACCATCCCCATCGTG<br>GGCATCATTGCTGGCCTGGTTCTCTTTGGAGCTGTGATCACTGGAGCTGTGGTCGCTG<br>CTGTGATGTGGAGGAGGAAGAGCTCAGGTGGGGAAGGGGTGAAGGGTGGGTCTGAG<br>ATTTCTTGTCTCACTGAGGGTTCCAAGACCCAGGTAGAAGTGTGCCCTGCCTCGTTAC<br>TGGGAAGCACCACCCACAATTATGGGCCTACCCAGCCTGGGCCCTGTGTGCCAGCAC<br>TTACTCTTTTGTAAAGCACCTGTTAAAATGAAGGACAGATTTATCACCTTGATTACAG<br>CGGTGATGGGACCTGATCCCAGCAGTCACAAGTCACAGGGGAAGGTCCCTGAGGACC<br>TTCAGGAGGGCGGTTGGTCCAGGACCCACACCTGCTTTCTTCATGTTTCCTGATCCCG<br>CCCTGGGTCTGCAGTCACACATTTCTGGAAACTTCTCTGAGGTCCAAGACTTGGAGGT<br>TCCTCTAGGACCTTAAGGCCCTGACTCCTTTCTGGTATCTCACAGGACATTTTCTTCCC<br>ACAGATAGAAAAGGAGGGAGCTACTCTCAGGCTGCAAGTAAGTATGAAGGAGGCTG<br>ATGCCTGAGGTCCTTGGGATATTGTGTTTGGGAGCCCATGGGGGAGCTCACCCACCC<br>CACAATTCCTCCTCTAGCCACATCTTCTGTGGGATCTGACCAGGTTCTGTTTTTGTTCT<br>ACCCCAGGCAGTGACAGTGCCCAGGGCTCTGATGTGTCTCTCACAGCTTGTAAAGGT<br>GAGAGCCTGGAGGGCCTGATGTGTGTTGGGTGTTGGGCGGAACAGTGGACACAGCTG<br>TGCTATGGGGTTTCTTTCCATTGGATGTATTGAGCATGCGATGGGCTGTTTAAAGTGT<br>GACCCCTCACTGTGACAGATACGAATTTGTTCATGAATATTTTTTCTATAGTGTGAG<br>ACAGCTGCCTTGTGTGGGACTGAGAGGCAAGAGTTGTTCCTGCCCTTCCCTTTGTGAC<br>TTGAAGAACCCTGACTTTGTTTCTGCAAAGGCACCTGCATGTGTCTGTGTTCGTGTAG<br>GCATAATGTGAGGAGGTGGGGAGACCACCCCACCCCCATGTCCACCATGACCCTCTT<br>CCCACGCTGACCTGTGCTCCCTCCCCAATCATCTTTCCTGTTCCAGAGAGGTGGGGCT<br>GAGGTGTCTCCATCTCTGTCTCAACTTCATGGTGCACTGAGCTGTAACTTCTTCCTTCC<br>CTATTAAAA (SEQ ID NO: 169) |

The person of ordinary skill in the art will appreciate that T can be substituted for U to convert an RNA sequence to a DNA sequence and vice versa, and both are envisaged as target gene sequences of the disclosure.

In some embodiments, a target gene is edited in the immune cells described herein using a nucleic acid guided endonuclease. Exemplary nucleic acid guided endonucleases include Class II endonucleases, such as CRISPR/Cas9.

"CRISPR" or "CRISPR gene editing" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence, knock out, or mutate a target gene. This system is a type of prokaryotic immune system that confers resistance to foreign genetic elements such as plasmids and phages and provides a form of acquired immunity. The CRISPR/Cas system has been modified for use in gene editing. This is accomplished by introducing into the eukaryotic cell a one or more specifically designed guide nucleic acids (gNAs), typically guide RNAs (gRNAs), and an appropriate Cas endonuclease which forms a ribonucleoprotein complex with the gNA. The gNA guides the gNA-endonuclease protein complex to a target genomic location, and the endonuclease introduces a strand break at the target genomic location. This double strand break can be repaired by cellular mechanisms such non-homologous end joining (leading to deletions) or homologous repair (which can generate insertions), thereby introducing genetic modifications into the host cell genome.

CRISPR/Cas systems are classified by class and by type. Class 2 systems currently represent a single interference protein that is categorized into three distinct types (types II, V and VI). Any class 2 CRISPR/Cas system suitable for gene editing, for example a type II, a type V or a type VI system, is envisaged as within the scope of the instant disclosure. Exemplary Class 2 type II CRISPR systems include Cas9, Csn2 and Cas4. Exemplary Class 2, type V CRISPR systems include, Cas12, Cas12a (Cpf1), Cas12b (C2c1), Cas12c (C2c3), Cas12d (CasY), Cas12e (CasX), Cas12f, Cas12g, Cas12h, Cas12i and Cas12k (C2c5). Exemplary Class 2 Type VI systems include Cas13, Cas13a (C2c2) Cas13b, Cas13c and Cas13d.

The CRISPR sequence, sometimes called a CRISPR locus, comprises alternating repeats and spacers. In a naturally-occurring CRISPR, the spacers usually comprise sequences foreign to the bacterium such as a plasmid or phage sequence. As described herein, spacer sequences may also be referred to as "targeting sequences." In CRISPR/Cas systems for a genetic engineering, the spacers are derived from the target gene sequence (the gNA).

An exemplary Class 2 type II CRISPR system relies on the protein Cas9, which is a nuclease with two active cutting sites, one for each strand of the double helix. Combining Cas9 and modified CRISPR locus RNA can be used in a system for gene editing. Pennisi (2013) Science 341: 833-836. In some embodiments, the Cas protein used to modify the immune cells is Cas9.

The CRISPR/Cas system can thus be used to edit a target gene, such as a gene targeted for editing in the immune cells described herein, by adding or deleting a base pair, or introducing a premature stop which thus decreases expression of the target. The CRISPR/Cas system can alternatively be used like RNA interference, turning off a target gene in a reversible fashion. In a mammalian cell, for example, the RNA can guide the Cas protein to a target gene promoter, sterically blocking RNA polymerases.

A Cas protein may be derived from any bacterial or archaeal Cas protein. Any suitable CRISPR/Cas system is envisaged as within the scope of the instant disclosure. In other aspects, Cas protein comprises one or more of Cas1, Cas1B, Cas2, Cas3, Cas4, Cas5, Cas6, Cas7, Cas8, Cas9, Cas10, Cas12a (Cpf1), Cas13, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, CasX, CasY, homologs thereof, or modified versions thereof. In some embodiments, the Cas protein is a Cas9 protein, a Cpf1 protein, a C2c1 protein, a C2c2 protein, a C2c3 protein, Cas3, Cas3-HD, Cas 5, Cas7, Cas8, Cas10, or combinations or complexes of these. In some embodiments, the Cas protein is a Cas9 protein.

Artificial CRISPR/Cas systems can be generated which inhibit a target gene, using technology known in the art, e.g., that described in U.S. Publication No. 20140068797, and Cong (2013) Science 339: 819-823. Other artificial CRISPR/Cas systems that are known in the art may also be generated which inhibit a target gene, e.g., that described in Tsai (2014) Nature Biotechnol., 32:6 569-576, U.S. Pat. Nos. 8,871,445; 8,865,406; 8,795,965; 8,771,945; and 8,697,359. Methods of designing suitable gNAs for a particular Cas protein will be known by persons of ordinary skill in the art.

The present disclosure provides gene-targeting guide nucleic acids (gNAs) that can direct the activities of an associated polypeptide (e.g., nucleic acid guided endonuclease) to a specific target gene sequence within a target nucleic acid genome. The genome-targeting nucleic acid can be an RNA. A genome-targeting RNA is referred to as a "guide RNA" or "gRNA" herein. A guide RNA can comprise at least a targeting sequence that hybridizes to a target nucleic acid sequence of interest, and a CRISPR repeat sequence. In some Type II systems, the gRNA also comprises a second RNA called the tracrRNA sequence, also referred to herein as a "scaffold" sequence. In the Type II guide RNA (gRNA), the CRISPR repeat sequence and scaffold sequence hybridize to each other to form a duplex. In the Type V guide RNA (gRNA), the crRNA forms a duplex. In both systems, the duplex can bind a site-directed polypeptide, such that the guide RNA and site-directed polypeptide form a complex. The gene-targeting nucleic acid can provide target specificity to the complex by virtue of its association with the site-directed polypeptide. The gene-targeting nucleic acid thus can direct the activity of the site-directed polypeptide.

In some embodiments, the disclosure provides a guide RNA comprising a targeting sequence and a guide RNA scaffold sequence, wherein the targeting sequence is complementary to the sequence of a target gene.

Exemplary guide RNAs include targeting sequences of about 15-20 bases. As is understood by the person of ordinary skill in the art, each gRNA can be designed to include a targeting sequence complementary to its genomic target sequence. For example, each of the targeting sequences, e.g., the RNA version of the DNA sequences presented in Table 8, minus the three 3' nucleotides which represent that PAM site, can be put into a single RNA chimera or a crRNA.

The gene targeting nucleic acid can be a double-molecule guide RNA. The gene targeting nucleic acid can be a single-molecule guide RNA. The gene targeting nucleic acid can be any known configuration of guide RNA known in the art, such as, for example, including paired gRNA, or multiple gRNAs used in a single step. Although it is clear from genomic sequences where the coding sequences and splice junctions are, other features required for gene expression may be idiosyncratic and unclear.

A double-molecule guide RNA can comprise two strands of RNA. The first strand comprises a sequence in the 5' to 3' direction, an optional spacer extension sequence, a targeting sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a targeting sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

In some embodiments, guide RNA or single-molecule guide RNA (sgRNA) can comprise a targeting sequence and a scaffold sequence. In some embodiments, the scaffold sequence is a Cas9 gRNA sequence. In some embodiments, the scaffold sequence is encoded by a DNA sequence that comprises a sequence that shares at least 90%, at least 95%, at least 96%, at least 97%, at least 98%, or at least 99% identity to GTTTTAGAGCTAGAAATAGCAAGT-TAAAATAAGGCTA GTCCGTTATCAACTT-GAAAAAGTGGCACCGAGTCGGTGCTTTTTTT (SEQ ID NO: 435). In some embodiments, the scaffold sequence is encoded by a DNA sequence that comprise sGTTT-TAGAGCTAGAAATAGCAAGT-TAAAATAAGGCTAGTCCGTTATCAACTTGAAA AAGTGGCACCGAGTCGGTGCTTTTTTT (SEQ ID NO: 435).

In some embodiments, for example those embodiments where the CRISPR/Cas system is a Cas9 system, the sgRNA can comprise a 20 nucleotide targeting sequence at the 5' end of the sgRNA sequence. The sgRNA can comprise a less than a 20 nucleotide targeting sequence at the 5' end of the sgRNA sequence. The sgRNA can comprise a more than 20 nucleotide targeting sequence at the 5' end of the sgRNA sequence. The sgRNA can comprise a variable length targeting sequence with 17-30 nucleotides at the 5' end of the sgRNA sequence.

Suitable scaffold sequences, and arrangement of scaffold targeting sequences, will depend on choice of endonuclease, and will be known to persons of skill in the art.

A single-molecule guide RNA (sgRNA) in a Type II system, e.g. Cas9, can comprise, in the 5' to 3' direction, a minimum CRISPR repeat sequence and a targeting sequence.

By way of illustration, guide RNAs used in the CRISPR/Cas9 or CRISPR/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

The targeting sequence of a gRNA hybridizes to a sequence in a target nucleic acid of interest. The targeting sequence of a genome-targeting nucleic acid can interact with a target nucleic acid in a sequence-specific manner via hybridization (i.e., base pairing). The nucleotide sequence of the targeting sequence can vary depending on the sequence of the target nucleic acid of interest.

In a Cas9 system described herein, the targeting sequence can be designed to hybridize to a target nucleic acid that is located 5' of the reverse complement of a PAM of the Cas9 enzyme used in the system. The targeting sequence may perfectly match the target sequence or may have mismatches. Each CRISPR/Cas system protein may have a particular PAM sequence, in a particular orientation and position, that it recognizes in a target DNA. For example, S. pyogenes Cas9 recognizes in a target nucleic acid a PAM that comprises the sequence 5'-NRG-3', where R comprises either A or G, where N is any nucleotide and N is immediately 3' of the target nucleic acid sequence targeted by the targeting sequence. Selection of appropriate PAM sequences will be apparent to the person of ordinary skill in the art.

The target sequence is complementary to, and hybridizes with, the targeting sequence of the gRNA. The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. In some embodiments, for example those embodiments where the CRISPR/Cas system is a Cas9 system, the target nucleic acid sequence can comprise 20 nucleotides immediately 5' of the first nucleotide of the reverse complement of the PAM sequence. This target nucleic acid sequence is often referred to as the PAM strand or a target strand, and the complementary nucleic acid sequence is often referred to the non-PAM strand or non-target strand. One of skill in the art would recognize that the targeting sequence hybridizes to the non-PAM strand of the target nucleic acid, see e.g., US20190185849A1.

In some examples, the percent complementarity between the targeting sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the targeting sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the targeting sequence and the target nucleic acid is 100% over the six contiguous 5'-most nucleotides of the target sequence of the complementary strand of the target nucleic acid. The percent complementarity between the targeting sequence and the target nucleic acid can be at least 60% over about 20 contiguous nucleotides. The length of the targeting sequence and the target nucleic acid can differ by 1 to 6 nucleotides, which may be thought of as a bulge or bulges.

The targeting sequence can be designed or chosen using computer programs known to persons of ordinary skill in the art. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like. Available computer programs can take as input NCBI gene IDs, official gene symbols, Ensembl Gene IDs, genomic coordinates, or DNA sequences, and create an output file containing sgRNAs targeting the appropriate genomic regions designated as input. The computer program may also provide a summary of statistics and scores indicating on- and off-target binding of the sgRNA for the target gene (Doench et al. *Nat Biotechnol.* 34:184-191 (2016)). The disclosure provides guide RNAs comprising a targeting sequence. In some embodiments, the guide RNA further comprises a guide RNA scaffold sequence. In some embodiments, the targeting sequence is complementary to the sequence of a target gene selected from the group consisting of HLA-A, HLA-B, HLA-C, B2M or an allele thereof. In some embodiments, the target gene is an HLA-A gene. In some embodiments, the target gene is an HLA-B gene. In some embodiments, the target gene is an HLA-C gene. In some embodiments the target gene is HLA-A, HLA-B, HLA-C, or a combination thereof. In some embodiments, targeting sequence comprises a sequence that shares about 90%, about 95%, about 96%, about 97%, about 98%, about 99% identity to or is identical to a sequence disclosed in Table 7.

In some embodiments, the gNAs specifically target the sequence of an endogenous HLA-A locus. In some embodiments, the gNAs that specifically target the sequence of an HLA-A locus comprise a sequence that shares about 90%, about 95%, about 96%, about 97%, about 98%, or about 99% identity to a sequence selected from the sequences disclosed in Table 8. In some embodiments, the gNAs that specifically target the sequence of an HLA-A locus comprise a sequence selected from the sequences disclosed in Table 8.

In some embodiments, the gNAs specifically target a sequence of HLA-A*02 alleles. For example, the gRNAs specifically target, and hybridize to, a sequence shared by all HLA-A*02 alleles, but that is not shared by HLA-A*02 and HLA-A*03 alleles. In some embodiments, the gNAs specifically target a sequence of HLA-A*02:01 alleles. In some embodiments, the gNAs specifically target a sequence of HLA-A*02:01:01 alleles. In some embodiments, the gNAs specifically target a sequence of HLA-A*02:01:01:01 alleles. In some embodiments, the gNAs specifically target a sequence of HLA-A*02:01:01:01 alleles.

In some embodiments, the gNAs specifically target a coding DNA sequence of HLA-A*02.

In some embodiments, the gNAs specifically target a coding DNA sequence that is shared by more than 1000 HLA-A*02 alleles. In some embodiments, the gNAs that specifically target a coding DNA sequence in greater than 1000 HLA-A*02 alleles comprise a sequence that shares about 90%, about 95%, about 96%, about 97%, about 98%, about 99% identity or is identical to a sequence selected from SEQ ID NOs: 400-465.

TABLE 8

Illustrative sequences targeting HLA-A and HLA-A alleles

| SEQ ID NO | Guide Nucleic Acid Targeting Sequences |
| --- | --- |
| 436 | TGGACGACACGCAGTTCGTG |
| 437 | CAGATACCTGGAGAACGGGA |
| 438 | TCCCGTTCTCCAGGTATCTG |
| 439 | CCGCCGCGGTCCAAGAGCGC |
| 440 | CCTGCGCTCTTGGACCGCGG |
| 441 | GGACCTGCGCTCTTGGACCGC |
| 442 | AAGGAGACGCTGCAGCGCACGGG |
| 443 | GAAGGAGACGCTGCAGCGCACGG |
| 444 | GCGGGCGCCGTGGATAGAGCAGG |

TABLE 8-continued

Illustrative sequences targeting HLA-A and HLA-A alleles

| SEQ ID NO | Guide Nucleic Acid Targeting Sequences |
| --- | --- |
| 445 | TGCTCTATCCACGGCGCCCGCGG |
| 446 | CGATGAAGCGGGGCTCCCCGCGG |
| 447 | CGTGTCCCGGCCCGGCCGCGGGG |
| 448 | CGGCTCCATCCTCTGGCTCGCGG |
| 449 | GATGTAATCCTTGCCGTCGTAGG |
| 450 | ACAGCGACGCCGCGAGCCAGAGG |
| 451 | GGATGGAGCCGCGGGCGCCGTGG |
| 452 | GGCGCCGTGGATAGAGCAGGAGG |
| 453 | GCGCCGTGGATAGAGCAGGAGGG |
| 454 | CGGCTACTACAACCAGAGCGAGG |
| 455 | CTGGTTGTAGTAGCCGCGCAGGG |
| 456 | TACTACAACCAGAGCGAGGCCGG |
| 457 | CTACCTGGAGGGCACGTGCGTGG |
| 458 | CACGCACGTGCCCTCCAGGTAGG |
| 459 | GCAGGGTCCCCAGGTCCACTCGG |
| 460 | GTGGACCTGGGGACCCTGCGCGG |
| 461 | TGGAGGGCACGTGCGTGGAGTGG |
| 462 | GTATGGCTGCGACGTGGGGTCGG |
| 463 | CTGAGCTGCCATGTCCGCCGCGG |
| 464 | GGATTACATCGCCCTGAAAGAGG |
| 465 | CAAGTGGGAGGCGGCCCATGTGG |
| 466 | GTGGGAGGCGGCCCATGTGGCGG |
| 467 | CAGTTGAGAGCCTACCTGGAGGG |
| 468 | GCAGTTGAGAGCCTACCTGGAGG |
| 469 | TACCACCAGTACGCCTACGACGG |
| 470 | TGCCGTCGTAGGCGTACTGGTGG |
| 471 | CCAGTACGCCTACGACGGCAAGG |
| 472 | GGATGTGAAGAAATACCTCATGG |
| 473 | ATTTCTTCACATCCGTGTCCCGG |
| 474 | AGGCGTACTGGTGGTACCCGCGG |
| 475 | CGTACTGGTGGTACCCGCGGAGG |
| 476 | GAGGATGTATGGCTGCGACGTGG |
| 477 | GGATGTATGGCTGCGACGTGGGG |
| 478 | CTCAGACCACCAAGCACAAGTGG |
| 479 | TCAGACCACCAAGCACAAGTGGG |
| 480 | CACCAAGCACAAGTGGGAGGCGG |

TABLE 8-continued

Illustrative sequences targeting HLA-A and HLA-A alleles

| SEQ ID NO | Guide Nucleic Acid Targeting Sequences |
|---|---|
| 481 | GACCACCAAGCACAAGTGGGAGG |
| 482 | GAGCCCCGCTTCATCGCAGTGGG |
| 483 | GTAGCCCACTGCGATGAAGCGGG |
| 484 | TAGCCCACTGCGATGAAGCGGGG |
| 485 | CGTAGCCCACTGCGATGAAGCGG |
| 486 | CTTCATCGCAGTGGGCTACGTGG |
| 487 | GGAGCCCCGCTTCATCGCAGTGG |
| 488 | CGGGGAGACACGGAAAGTGAAGG |
| 489 | AGTATTGGGACGGGGAGACACGG |
| 490 | AGGGTCCGGAGTATTGGGACGGG |
| 491 | GAGGGTCCGGAGTATTGGGACGG |
| 492 | GGACCCTCCTGCTCTATCCACGG |
| 493 | GTGGATAGAGCAGGAGGGTCCGG |
| 494 | AGACTCACCGAGTGGACCTGGGG |
| 495 | CACTCGGTGAGTCTGTGAGTGGG |
| 496 | CAGACTCACCGAGTGGACCTGGG |
| 497 | CCACTCACAGACTCACCGAGTGG |
| 498 | CCACTCGGTGAGTCTGTGAGTGG |
| 499 | TCGGACTGGCGCTTCCTCCGCGG |
| 500 | GCAGCCATACATCCTCTGGACGG |
| 501 | TCTCAACTGCTCCGCCACATGGG |
| 502 | ACCCTCATGCTGCACATGGCAGG |
| 503 | ACCTGCCATGTGCAGCATGAGGG |
| 504 | CACCTGCCATGTGCAGCATGAGG |
| 505 | GGAGGACCAGACCCAGGACACGG |
| 506 | GGATGGGAGGACCAGACCCAGG |
| 507 | GACCTGGCAGCGGGATGGGGAGG |
| 508 | AGATCACACTGACCTGGCAGCGG |
| 509 | GATCACACTGACCTGGCAGCGGG |
| 510 | AGGTCAGTGTGATCTCCGCAGGG |
| 511 | AAGCCCCTCACCCTGAGATGGG |
| 512 | CTGCGGAGATCACACTGACCTGG |
| 513 | CAGCAATGATGCCCACGATGGGG |
| 514 | CCAGCAATGATGCCCACGATGGG |
| 515 | GCCAGCAATGATGCCCACGATGG |
| 516 | GGATGGAACCTTCCAGAAGTGGG |
| 517 | GGGATGGAACCTTCCAGAAGTGG |
| 518 | ATGCCCACGATGGGGATGGTGGG |
| 519 | CAGCCCACCATCCCCATCGTGGG |
| 520 | CCAGCCCACCATCCCCATCGTGG |
| 521 | GATGCCCACGATGGGGATGGTGG |
| 522 | CAGGGCCCAGCACCTCAGGGTGG |
| 523 | AATGATGCCCACGATGGGGATGG |
| 524 | GGCCCTGACCCAGACCTGGGCGG |
| 525 | GACCCAGGACACGGAGCTCGTGG |
| 526 | ACACGGAGCTCGTGGAGACCAGG |
| 527 | CGTGGAGACCAGGCCTGCAGGGG |
| 528 | TCGTGGAGACCAGGCCTGCAGGG |
| 529 | AGCTGTGATCACTGGAGCTGTGG |
| 530 | AAAAGGAGGGAGCTACTCTCAGG |
| 531 | ATGTGGAGGAGGAAGAGCTCAGG |
| 532 | GTGTCTCTCACAGCTTGTAAAGG |
| 533 | GAGAGACACATCAGAGCCCTGGG |
| 534 | CTCCGCAGGGTAGAAGCTCAGGG |
| 535 | GGCCCTGAGCTTCTACCCTGCGG |
| 536 | GCTCAGGGCCCAGCACCTCAGGG |
| 537 | TATCTCTGCTCCTGTCCAGAAGG |
| 538 | AGTAGCAGGACGAGGGTTCGGGG |
| 539 | CCCCGAGAGTAGCAGGACGAGGG |
| 540 | CCCTCGTCCTGCTACTCTCGGGG |
| 541 | CCTCGTCCTGCTACTCTCGGGGG |
| 542 | CTGTGGTCGCTGCTGTGATGTGG |
| 543 | TCGCTGCTGTGATGTGGAGGAGG |
| 544 | TGGTCGCTGCTGTGATGTGGAGG |
| 545 | CACAGCCGCCCACTTCTGGAAGG |
| 546 | CCAGAAGTGGGCGGCTGTGGTGG |
| 547 | TGGAACCTTCCAGAAGTGGGCGG |
| 548 | TCACAGCTCCAAAGAGAACCAGG |
| 549 | CTGACCATGAAGCCACCCTGAGG |
| 550 | GCAAACCCTCATGCTGCACATGG |
| 551 | TGAAGCCACCCTGAGGTGCTGGG |
| 552 | GGTGAGTCATATGCGTTTTGGGG |
| 553 | GTGAGTCATATGCGTTTTGGGGG |

TABLE 8-continued

Illustrative sequences targeting HLA-A and HLA-A alleles

| SEQ ID NO | Guide Nucleic Acid Targeting Sequences |
|---|---|
| 554 | CTTCATGGTCAGAGACAGCGTGG |
| 555 | TCTGGCCCTGACCCAGACCTGGG |

The sequences disclosed in Table 8 include the corresponding genomic sequences, inclusive of the PAM sequence. The skilled artisan will understand that the targeting sequence of the gRNA does not include three 3' terminal nucleotides of the sequences in Table 8, which represent the corresponding PAM site for the gRNA.

The disclosure provides gNAs comprising a targeting sequence specific to the B2M gene. In some embodiments, the gNAs specifically target the coding sequence (CDS) sequence of the B2M gene. In some embodiments, the gNA comprises a sequence that targets the B2M gene promoter sequence.

In some embodiments the gNA comprise a targeting sequence and a gNA scaffold sequence. In some embodiments, the targeting sequence comprises a sequence set forth in Table 9, or a sequence shares about 90%, about 95%, about 96%, about 97%, about 98%, about 99% identity thereto.

In some embodiments, the targeting sequence is complementary to a sequence of the B2M gene. In some embodiments, the B2M gene comprises a sequence that shares about 90%, about 95%, about 96%, about 97%, about 98%, about 99% identity to the B32M sequence set forth in Table 7.

TABLE 9

Illustrative sequences targeting B2M

| SEQ ID NO | Sequence |
|---|---|
| 556 | CGCGAGCACAGCTAAGGCCA |
| 557 | GAGTAGCGCGAGCACAGCTA |
| 558 | AGGGTAGGAGAGACTCACGC |
| 559 | CTGAATCTTTGGAGTACCTG |
| 560 | TCACGTCATCCAGCAGAGAA |
| 561 | TCCTGAATTGCTATGTGTCT |
| 562 | AAGTCAACTTCAATGTCGGA |
| 563 | GTCTTTTCCCGATATTCCTC |
| 564 | TGGAGTACCTGAGGAATATC |
| 565 | CAGCCCAAGATAGTTAAGTG |
| 566 | ACAAAGTCACATGGTTCACA |
| 567 | ACTCTCTCTTTCTGGCCTGG |
| 568 | TGGGCTGTGACAAAGTCACA |
| 569 | GGCCGAGATGTCTCGCTCCG |
| 570 | CAGTAAGTCAACTTCAATGT |
| 571 | ACTCACGCTGGATAGCCTCC |

TABLE 9-continued

Illustrative sequences targeting B2M

| SEQ ID NO | Sequence |
|---|---|
| 572 | CATACTCATCTTTTTCAGTG |
| 573 | CACAGCCCAAGATAGTTAAG |
| 574 | TTCAGACTTGTCTTTCAGCA |
| 575 | AGTCACATGGTTCACACGGC |
| 576 | ATACTCATCTTTTTCAGTGG |
| 577 | GGCATACTCATCTTTTTCAG |
| 578 | ACAGCCCAAGATAGTTAAGT |
| 579 | GCTACTCTCTCTTTCTGGCC |
| 580 | TGGAGAGAGAATTGAAAAAG |
| 581 | ACTTGTCTTTCAGCAAGGAC |
| 582 | GAAGTTGACTTACTGAAGAA |
| 583 | GGCCACGGAGCGAGACATCT |
| 584 | GCATACTCATCTTTTTCAGT |
| 585 | CGTGAGTAAACCTGAATCTT |
| 586 | TTACCCCACTTAACTATCTT |
| 587 | TTGGAGTACCTGAGGAATAT |
| 588 | ACCCAGACACATAGCAATTC |
| 589 | TTTGACTTTCCATTCTCTGC |
| 590 | TTCCTGAATTGCTATGTGTC |
| 591 | CTCAGGTACTCCAAAGATTC |
| 592 | CTTACCCCACTTAACTATCT |
| 593 | CTCGCGCTACTCTCTCTTTC |
| 594 | TCGATCTATGAAAAAGACAG |
| 595 | GAGACATGTAAGCAGCATCA |
| 596 | ACATGTAAGCAGCATCATGG |
| 597 | GAAGTCCTAGAATGAGCGCC |
| 598 | GAGCGCCGGTGTCCCAAGC |
| 599 | AGCGCCCGGTGTCCCAAGCT |
| 600 | GCGCCCGGTGTCCCAAGCTG |
| 601 | CTGGGGCGCGCACCCCAGAT |
| 602 | GGGCGCGCACCCCAGATCGG |
| 603 | GGCGCGCACCCCAGATCGGA |
| 604 | CATCACGAGACTCTAAGAAA |
| 605 | TAAGAAAAGGAAACTGAAAA |
| 606 | AAGAAAAGGAAACTGAAAAC |
| 607 | GAAAGTCCCTCTCTCTAACC |
| 608 | CTAACCTGGCACTGCGTCGC |

TABLE 9-continued

Illustrative sequences targeting B2M

| SEQ ID NO | Sequence |
|---|---|
| 609 | CTGGCACTGCGTCGCTGGCT |
| 610 | TGCGTCGCTGGCTTGGAGAC |
| 611 | GCTGGCTTGGAGACAGGTGA |
| 612 | GAGACAGGTGACGGTCCCTG |
| 613 | AGACAGGTGACGGTCCCTGC |
| 614 | CCTGCGGGCCTTGTCCTGAT |
| 615 | CGGGCCTTGTCCTGATTGGC |
| 616 | GGGCCTTGTCCTGATTGGCT |
| 617 | GGGCACGCGTTTAATATAAG |
| 618 | CACGCGTTTAATATAAGTGG |
| 619 | TATAAGTGGAGGCGTCGCGC |
| 620 | AAGTGGAGGCGTCGCGCTGG |
| 621 | AGTGGAGGCGTCGCGCTGGC |
| 622 | TTCCTGAAGCTGACAGCATT |
| 623 | TCCTGAAGCTGACAGCATTC |
| 624 | GCCCGAATGCTGTCAGCTTC |
| 625 | AAACGCGTGCCCAGCCAATC |
| 626 | GTGCCCAGCCAATCAGGACA |
| 627 | CCAATCAGGACAAGGCCCGC |
| 628 | CAATCAGGACAAGGCCCGCA |
| 629 | CAAGCCAGCGACGCAGTGCC |
| 630 | CGCAGTGCCAGGTTAGAGAG |
| 631 | GCAGTGCCAGGTTAGAGAGA |
| 632 | GAGTCTCGTGATGTTTAAGA |
| 633 | TAAGAAGGCATGCACTAGAC |
| 634 | AAGAAGGCATGCACTAGACT |
| 635 | TGAGTTTGCTGTCTGTACAT |
| 636 | TACATCGGCGCCCTCCGATC |
| 637 | ACATCGGCGCCCTCCGATCT |
| 638 | CATCGGCGCCCTCCGATCTG |
| 639 | CTGGGGTGCGCGCCCCAGCT |
| 640 | TGGGGTGCGCGCCCCAGCTT |
| 641 | CGCGCCCCAGCTTGGGACAC |
| 642 | GCGCCCCAGCTTGGGACACC |
| 643 | CAAGTCACTTAGCATCTCTG |
| 644 | ACAGAAGTTCTCCTTCTGCT |
| 645 | ATTCAAAGATCTTAATCTTC |
| 646 | TTCAAAGATCTTAATCTTCT |

TABLE 9-continued

Illustrative sequences targeting B2M

| SEQ ID NO | Sequence |
|---|---|
| 647 | TTTTCTCGAATGAAAAATGC |
| 648 | TGCAGGTCCGAGCAGTTAAC |
| 649 | GGTCCGAGCAGTTAACTGGC |
| 650 | GTCCGAGCAGTTAACTGGCT |
| 651 | TCCGAGCAGTTAACTGGCTG |
| 652 | AGCAAGTCACTTAGCATCTC |
| 653 | GCAAGTCACTTAGCATCTCT |
| 654 | TGGGGCCAGTCTGCAAAGCG |
| 655 | GGGGCCAGTCTGCAAAGCGA |
| 656 | GGGCCAGTCTGCAAAGCGAG |
| 657 | GGCCAGTCTGCAAAGCGAGG |
| 658 | GGACACCGGGCGCTCATTCT |
| 659 | GGCGCTCATTCTAGGACTTC |
| 660 | CTCATTCTAGGACTTCAGGC |
| 661 | ATTCTAGGACTTCAGGCTGG |
| 662 | TTCAGGCTGGAGGCACATTA |
| 663 | TGCCCCCTCGCTTTGCAGAC |
| 664 | GATGCTAAGTGACTTGCTAA |
| 665 | GCCCCAGCCAGTTAACTGCT |
| 666 | GCATTTTTCATTCGAGAAAA |
| 667 | TTTGAATGCTACCTAGCAGA |
| 668 | TTCTGTTTATAACTACAGCT |
| 669 | TCTGTTTATAACTACAGCTT |

In some embodiments, the immune cells described herein are edited using TALEN gene editing.

"TALEN" or "TALEN gene editing" refers to a transcription activator-like effector nuclease, which is an artificial nuclease used to edit a target gene.

TALENs are produced artificially by fusing a TAL effector DNA binding domain to a DNA cleavage domain. Transcription activator-like effectors (TALEs) derived from *Xanthomonas* bacteria can be engineered to bind any desired DNA sequence, including a portion of target genes such as TCR subunits, MHC class I complex components, or CD52. By combining an engineered TALE with a DNA cleavage domain, a restriction enzyme can be produced which is specific to any desired DNA sequence, including a target gene sequence. These can then be introduced into a cell, wherein they can be used for genome editing.

To produce a TALEN, a TALE protein is fused to a nuclease (N), which is a wild-type or mutated FokI endonuclease. Several mutations to FokI have been made for its use in TALENs; these, for example, improve cleavage specificity or activity.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity.

TALENs specific to sequences in a target gene can be constructed using any method known in the art, including various schemes using modular components.

In some embodiments, a target gene is edited in the immune cells described herein using ZFN gene editing.

"ZFN" or "Zinc Finger Nuclease" or "ZFN gene editing" refer to a zinc finger nuclease, an artificial nuclease which can be used to edit a target gene.

Like a TALEN, a ZFN comprises a FokI nuclease domain (or derivative thereof) fused to a DNA-binding domain. In the case of a ZFN, the DNA-binding domain comprises one or more zinc fingers.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart.

Also like a TALEN, a ZFN can create a double-stranded break in the DNA, which can create a frame-shift mutation if improperly repaired, leading to a decrease in the expression and amount of a target gene or gene product in a cell. ZFNs can also be used with homologous recombination to mutate in a target gene.

ZFNs specific to sequences in a target gene can be constructed using any method known in the art.

In some embodiments, the expression and of function of one or more MCH-I components are reduced using RNA interference. "RNAi" or "RNA interference" refers to the process of sequence-specific post-transcriptional gene silencing, mediated by double-stranded RNA (dsRNA). Duplex RNAs such as siRNA (small interfering RNA), miRNA (micro RNA), shRNA (short hairpin RNA), ddRNA (DNA-directed RNA), piRNA (Piwi-interacting RNA), or rasiRNA (repeat associated siRNA) and modified forms thereof are all capable of mediating RNA interference. These dsRNA molecules may be commercially available or may be designed and prepared based on known sequence information. The anti-sense strand of these molecules can include RNA, DNA, PNA, or a combination thereof. DNA/RNA chimeric polynucleotides include, but are not limited to, a double-strand polynucleotide composed of DNA and RNA that inhibits the expression of a target gene. dsRNA molecules can also include one or more modified nucleotides, as described herein, which can be incorporated on either or both strands.

In RNAi gene silencing or knockdown, dsRNA comprising a first (anti-sense) strand that is complementary to a portion of a target gene and a second (sense) strand that is fully or partially complementary to the first anti-sense strand is introduced into an organism. After introduction into the organism, the target gene-specific dsRNA is processed into relatively small fragments (siRNAs) and can subsequently become distributed throughout the organism, decrease messenger RNA of target gene, leading to a phenotype that may come to closely resemble the phenotype arising from a complete or partial deletion of the target gene.

Certain dsRNAs in cells can undergo the action of Dicer enzyme, a ribonuclease III enzyme. Dicer can process the dsRNA into shorter pieces of dsRNA, i.e. siRNAs. RNAi also involves an endonuclease complex known as the RNA induced silencing complex (RISC). Following cleavage by Dicer, siRNAs enter the RISC complex and direct cleavage of a single stranded RNA target having a sequence complementary to the anti-sense strand of the siRNA duplex. The other strand of the siRNA is the passenger strand. Cleavage of the target RNA takes place in the middle of the region complementary to the anti-sense strand of the siRNA duplex. siRNAs can thus down regulate or knock down gene expression by mediating RNA interference in a sequence-specific manner.

As used herein with respect to RNA interference, "target gene" or "target sequence" refers to a gene or gene sequence whose corresponding RNA is targeted for degradation through the RNAi pathway using dsRNAs or siRNAs as described herein. Exemplary target gene sequences are shown in Table 7. To target a gene, for example using an siRNA, the siRNA comprises an anti-sense region complementary to, or substantially complementary to, at least a portion of the target gene or sequence, and sense strand complementary to the anti-sense strand. Once introduced into a cell, the siRNA directs the RISC complex to cleave an RNA comprising a target sequence, thereby degrading the RNA. The disclosure provides interfering RNAs. The double stranded RNA molecule of the disclosure may be in the form of any type of RNA interference molecule known in the art. In some embodiments, the double stranded RNA molecule is a small interfering RNA (siRNA). In other embodiments, the double stranded RNA molecule is a short hairpin RNA (shRNA) molecule. In other embodiments, the double stranded RNA molecule is a Dicer substrate that is processed in a cell to produce an siRNA. In other embodiments the double stranded RNA molecule is part of a microRNA precursor molecule.

In some embodiments, the shRNA is a length to be suitable as a Dicer substrate, which can be processed to produce a RISC active siRNA molecule. See, e.g., Rossi et al., US2005/0244858.

A Dicer substrate double stranded RNA (e.g. a shRNA) can be of a length sufficient that it is processed by Dicer to produce an active siRNA, and may further include one or more of the following properties: (i) the Dicer substrate shRNA can be asymmetric, for example, having a 3' overhang on the anti-sense strand, (ii) the Dicer substrate shRNA can have a modified 3' end on the sense strand to direct orientation of Dicer binding and processing of the dsRNA to an active siRNA, for example the incorporation of one or more DNA nucleotides, and (iii) the first and second strands of the Dicer substrate ds RNA can be from 21-30 bp in length.

In some embodiments, the interfering RNAs comprise a sequence complementary to a sequence of a B2M mRNA. In some embodiments, the interfering RNA is capable of inducing RNAi-mediated degradation of the B2M mRNA. In some embodiments, the B2M mRNA sequence comprises a coding sequence. In some embodiments, the B2M mRNA sequence comprises an untranslated region.

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the B2M mRNA; and a second sequence, having from 5' to 3' end a sequence complementary to the first sequence, wherein the first sequence and second sequence form the shRNA.

In some embodiments, the first sequence is 18, 19, 20, 21, or 22 nucleotides. In some embodiments, the first sequence is complementary to a sequence selected from the sequences set forth in Tables 10 and 11. In some embodiments, the first sequence has GC content greater than or equal to 25% and less than 60%. In some embodiments, the first sequence is complementary to a sequence selected from the sequences set forth in Tables 10 and 11. In some embodiments, the first sequence does not comprise four nucleotides of the same base or a run of seven C or G nucleotide bases. In some embodiments, the first sequence is 21 nucleotides.

Illustrative target B32M sequences complementary to the first sequence are shown in Table 10.

In some cases, the first sequence may have 100% identity, i.e. complete identity, homology, complementarity to the target nucleic acid sequence. In other cases, there may be one or more mismatches between the first sequence and the target nucleic acid sequence. For example, there may be 1, 2, 3, 4, 5, 6, or 7 mismatches between the sense region and the target nucleic acid sequence.

The sequences set forth in Table 10 are presented as DNA sequences. In all sequences set forth in Table 10, thymine (T) may be replaced by uracil (U) to arrive at the sequence of the target mRNA sequence.

TABLE 10

Illustrative target B2M sequences complementary to first sequence.

| SEQ ID NO | Sequence |
|---|---|
| 670 | AGAGAATGGAAAGTCAAATTT |
| 671 | ATGGACATGATCTTCTTTATA |
| 672 | TGGACATGATCTTCTTTATAA |
| 673 | GGACATGATCTTCTTTATAAT |
| 674 | TGACAGGATTATTGGAAATTT |
| 675 | TTGTGGTTAATCTGGTTTATT |
| 676 | TGTGGTTAATCTGGTTTATTT |
| 677 | GCAGAGAATGGAAAGTCAAAT |
| 678 | CAGAGAATGGAAAGTCAAATT |
| 679 | GAGAATGGAAAGTCAAATTTC |
| 680 | GTCACAGCCCAAGATAGTTAA |
| 681 | TGCTTATACACTTACACTTTA |

TABLE 10-continued

Illustrative target B2M sequences complementary to first sequence.

| SEQ ID NO | Sequence |
|---|---|
| 682 | GCTTATACACTTACACTTTAT |
| 683 | CTTATACACTTACACTTTATG |
| 684 | ACATGGACATGATCTTCTTTA |
| 685 | CATGGACATGATCTTCTTTAT |
| 686 | ATCAACATCTTGGTCAGATTT |
| 687 | CTTGCACTCAAAGCTTGTTAA |
| 688 | AGTTAAGCGTGCATAAGTTAA |
| 689 | GCATAAGTTAACTTCCAATTT |
| 690 | TACATACTCTGCTTAGAATTT |
| 691 | ACATACTCTGCTTAGAATTTG |
| 692 | TTGACAGGATTATTGGAAATT |
| 693 | GACAGGATTATTGGAAATTTG |
| 694 | TAAGGCATGGTTGTGGTTAAT |
| 695 | GTTGTGGTTAATCTGGTTTAT |
| 696 | GTTCCACAAGTTAAATAAATC |
| 697 | TCCAGCGTACTCCAAAGATTC |
| 698 | TACTCCAAAGATTCAGGTTTA |
| 699 | ACTCCAAAGATTCAGGTTTAC |
| 700 | CACGTCATCCAGCAGAGAATG |
| 701 | GGTTTCATCCATCCGACATTG |
| 702 | CCGACATTGAAGTTGACTTAC |
| 703 | TGAAGAATGGAGAGAGAATTG |
| 704 | GAGCATTCAGACTTGTCTTTC |
| 705 | TTCAGCAAGGACTGGTCTTTC |
| 706 | GCAAGGACTGGTCTTTCTATC |
| 707 | CGTGTGAACCATGTGACTTTG |
| 708 | CTTTGTCACAGCCCAAGATAG |
| 709 | TCACAGCCCAAGATAGTTAAG |
| 710 | AGTGGGATCGAGACATGTAAG |
| 711 | AGGTTTGAAGATGCCGCATTT |
| 712 | GGTTTGAAGATGCCGCATTTG |
| 713 | TTGATATGCTTATACACTTAC |
| 714 | TGAGTGCTGTCTCCATGTTTG |
| 715 | TGTCTCCATGTTTGATGTATC |
| 716 | TCAACATCTTGGTCAGATTTG |
| 717 | TCAGATTTGAACTCTTCAATC |
| 718 | TTCAATCTCTTGCACTCAAAG |

TABLE 10-continued

Illustrative target B2M sequences complementary to first sequence.

| SEQ ID NO | Sequence |
|---|---|
| 719 | TTGCACTCAAAGCTTGTTAAG |
| 720 | ACTCAAAGCTTGTTAAGATAG |
| 721 | AGATAGTTAAGCGTGCATAAG |
| 722 | TGCATAAGTTAACTTCCAATT |
| 723 | GTTAACTTCCAATTTACATAC |
| 724 | ATTGACAGGATTATTGGAAAT |
| 725 | GTAAGGCATGGTTGTGGTTAA |
| 726 | GGTTGTGGTTAATCTGGTTTA |
| 727 | TTCCTGAAGCTGACAGCATTC |
| 728 | GCTATCCAGCGTACTCCAAAG |
| 729 | CATCCAGCAGAGAATGGAAAG |
| 730 | CAAATTTCCTGAATTGCTATG |
| 731 | ATTGCTATGTGTCTGGGTTTC |
| 732 | GAAGATGCCGCATTTGGATTG |
| 733 | CAATTTACATACTCTGCTTAG |
| 734 | TATCCAGCGTACTCCAAAGAT |
| 735 | ATCCAGCGTACTCCAAAGATT |
| 736 | CTCCAAAGATTCAGGTTTACT |
| 737 | TGCTATGTGTCTGGGTTTCAT |
| 738 | TTTCATCCATCCGACATTGAA |
| 739 | GAAGTTGACTTACTGAAGAAT |
| 740 | GAAGAATGGAGAGAGAATTGA |
| 741 | AGAATGGAGAGAGAATTGAAA |
| 742 | CAGCAAGGACTGGTCTTTCTA |
| 743 | AGCAAGGACTGGTCTTTCTAT |
| 744 | ACTTTGTCACAGCCCAAGATA |
| 745 | TTGTCACAGCCCAAGATAGTT |
| 746 | TGTCACAGCCCAAGATAGTTA |
| 747 | CACAGCCCAAGATAGTTAAGT |
| 748 | GCAGCATCATGGAGGTTTGAA |
| 749 | CCGCATTTGGATTGGATGAAT |
| 750 | TTGAGTGCTGTCTCCATGTTT |
| 751 | AGTGCTGTCTCCATGTTTGAT |
| 752 | CTGTCTCCATGTTTGATGTAT |
| 753 | TCTAGGAGGGCTGGCAACTTA |
| 754 | CAACATCTTGGTCAGATTTGA |
| 755 | GTCAGATTTGAACTCTTCAAT |
| 756 | TCTTGCACTCAAAGCTTGTTA |
| 757 | TGCACTCAAAGCTTGTTAAGA |
| 758 | GCACTCAAAGCTTGTTAAGAT |
| 759 | CACTCAAAGCTTGTTAAGATA |
| 760 | TCAAAGCTTGTTAAGATAGTT |
| 761 | CAAAGCTTGTTAAGATAGTTA |
| 762 | GATAGTTAAGCGTGCATAAGT |
| 763 | ATAGTTAAGCGTGCATAAGTT |
| 764 | TAGTTAAGCGTGCATAAGTTA |
| 765 | TTAAGCGTGCATAAGTTAACT |
| 766 | TAAGCGTGCATAAGTTAACTT |
| 767 | ATTTACATACTCTGCTTAGAA |
| 768 | TTTACATACTCTGCTTAGAAT |
| 769 | ACAGGATTATTGGAAATTTGT |
| 770 | CAGGATTATTGGAAATTTGTT |
| 771 | AGGCATGGTTGTGGTTAATCT |
| 772 | CAGCAGAGAATGGAAAGTCAA |
| 773 | TCCGACATTGAAGTTGACTTA |
| 774 | CTGGTCTTTCTATCTCTTGTA |
| 775 | CCGTGTGAACCATGTGACTTT |
| 776 | CCCAAGATAGTTAAGTGGGAT |
| 777 | GGTTGCTCCACAGGTAGCTCT |
| 778 | GCTCCACAGGTAGCTCTAGGA |
| 779 | GGGAGCAGAGAATTCTCTTAT |
| 780 | GGAGCAGAGAATTCTCTTATC |
| 781 | GAGCAGAGAATTCTCTTATCC |
| 782 | GAGAATTCTCTTATCCAACAT |
| 783 | GAATTCTCTTATCCAACATCA |
| 784 | AAGTGGAGCATTCAGACTTGT |
| 785 | AAGGACTGGTCTTTCTATCTC |
| 786 | AAGCTTGTTAAGATAGTTAAG |
| 787 | AAGCGTGCATAAGTTAACTTC |
| 788 | AAGATGCCGCATTTGGATTGG |
| 789 | AAGAATGGAGAGAGAATTGAA |

TABLE 10-continued

Illustrative target B2M sequences complementary to first sequence.

| SEQ ID NO | Sequence |
|---|---|
| 790 | AACATCAACATCTTGGTCAGA |
| 791 | AAGGCATGGTTGTGGTTAATC |
| 792 | AAGCAGCATCATGGAGGTTTG |
| 793 | AAGATGAGTATGCCTGCCGTG |
| 794 | AAGTTGACTTACTGAAGAATG |
| 795 | AAGATAGTTAAGCGTGCATAA |
| 796 | AACTTCCAATTTACATACTCT |
| 797 | AACATCTTGGTCAGATTTGAA |
| 798 | AACTCTTCAATCTCTTGCACT |
| 799 | AATTTCCTGAATTGCTATGTG |
| 800 | AATGGAAAGTCAAATTTCCTG |
| 801 | AACCATGTGACTTTGTCACAG |
| 802 | AATTGACAGGATTATTGGAAA |
| 803 | AATTCTCTTATCCAACATCAA |
| 804 | AAAGTGGAGCATTCAGACTTG |
| 805 | AAAGTCAAATTTCCTGAATTG |
| 806 | GTTGCTCCACAGGTAGCTCTA |
| 807 | AATTTACATACTCTGCTTAGA |

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

An exemplary sequence encoding a B32M shRNA comprises a sequence of GCACTCAAAGCTTGTTAAGATCGAAATCTTAACAAGCTTTGAGTGC (SEQ TD NO: 179), or a sequence having at least 9000, at least 9500, at least 970% or at least 990% identity thereto. A further exemplary sequence encoding a B2M shRNA comprises a sequence of GTTAACTTCCAATTTACATACCGAAGTATGTAAATTGGAAGTTAAC (SEQ TD NO: 808), or a sequence having at least 90%, at least 9500 at least 9700 or at least 9900 identity thereto.

In some embodiments, the interfering RNA is a short hairpin RNA (shRNA). In some embodiments, the shRNA comprises a first sequence, having from 5' to 3' end a sequence complementary to the HLA-A*02 mRNA; and a second sequence, having from 5' to 3' end a sequence complementary to the first sequence, wherein the first sequence and second sequence form the shRNA Illustrative target HLA sequences complementary to the first sequence are shown in Table 11.

TABLE 11

Illustrative target HLA sequences complementary to first sequence

| SEQ ID NO | Sequence |
|---|---|
| 809 | CTTCTTCCTTCCCTATTAAAA |
| 810 | TCTCACTCCATGAGGTATTTC |
| 811 | CTCTCACTCCATGAGGTATTT |
| 812 | GAGGAGGAAGAGCTCAGATAG |
| 813 | GCTCTCACTCCATGAGGTATT |
| 814 | AGGATTACATCGCCCTGAAAG |
| 815 | ACACCGTCCAGAGGATGTATG |
| 816 | AGGGTCCTTCTTCCTGGATAC |
| 817 | CCTACGACGGCAAGGATTACA |
| 818 | TCACTCCATGAGGTATTTCTT |
| 819 | CTACGACGGCAAGGATTACAT |
| 820 | CTCACTCCATGAGGTATTTCT |
| 821 | GGAGGAAGAGCTCAGATAGAA |
| 822 | CACACCGTCCAGAGGATGTAT |
| 823 | CACGCTGTCTCTGACCATGAA |
| 824 | CTGGACAGGAGCAGAGATACA |
| 825 | TGGAGGAGGAAGAGCTCAGAT |
| 826 | GGCTCTCACTCCATGAGGTAT |
| 827 | CATCTCTGTCTCAACTTCATG |
| 828 | TACGACGGCAAGGATTACATC |
| 829 | GGATTACATCGCCCTGAAAGA |
| 830 | GATTACATCGCCCTGAAAGAG |
| 831 | CTCAGACCACCAAGCACAAGT |
| 832 | TCACACCGTCCAGAGGATGTA |
| 833 | ACTCCATGAGGTATTTCTTCA |
| 834 | CACTCCATGAGGTATTTCTTC |
| 835 | CCATGAGGTATTTCTTCACAT |
| 836 | ACTTCTTCCTTCCCTATTAAA |
| 837 | GTGTCTCTCACAGCTTGTAAA |
| 838 | CTGTGTTCGTGTAGGCATAAT |
| 839 | TGTGTTCGTGTAGGCATAATG |
| 840 | TAACTTCTTCCTTCCCTATTA |
| 841 | TCTGGACAGGAGCAGAGATAC |
| 842 | TTGCTGGCCTGGTTCTCTTTG |
| 843 | TGTCTCTCACAGCTTGTAAAG |
| 844 | ACTTGAAGAACCCTGACTTTG |
| 845 | GAAGAACCCTGACTTTGTTTC |

TABLE 11-continued

Illustrative target HLA sequences complementary to first sequence

| SEQ ID NO | Sequence |
|---|---|
| 846 | TCTGTGTTCGTGTAGGCATAA |
| 847 | CATGGTGCACTGAGCTGTAAC |
| 848 | GTAACTTCTTCCTTCCCTATT |
| 849 | CATGTGCAGCATGAGGGTTTG |
| 850 | TTGTTCCTGCCCTTCCCTTTG |
| 851 | ACCCAGTTCTCACTCCCATTG |
| 852 | GGGTTTCCAGAGAAGCCAATC |
| 853 | TTCTCCCTCTCCAACCTATG |
| 854 | GTCTCTCACAGCTTGTAAAGT |
| 855 | TGTGTCTCTCACAGCTTGTAA |
| 856 | GAGGAAGAGCTCAGATAGAAA |
| 857 | TGAAGAACCCTGACTTTGTTT |
| 858 | TTGAAGAACCCTGACTTTGTT |
| 859 | GTGTTCGTGTAGGCATAATGT |
| 860 | TGGTGCACTGAGCTGTAACTT |
| 861 | CTCCCTCTCCAACCTATGTA |
| 862 | AGGAGGAAGAGCTCAGATAGA |
| 863 | ACCTATGTAGGGTCCTTCTTC |
| 864 | GGGTCCTTCTTCCTGGATACT |
| 865 | GGTCCTTCTTCCTGGATACTC |
| 866 | GTCCTTCTTCCTGGATACTCA |
| 867 | AAGCCAATCAGTGTCGTCGCG |
| 868 | AAGAGGACCTGCGCTCTTGGA |
| 869 | AAGTGTGAGACAGCTGCCTTG |
| 870 | AAGGCACCTGCATGTGTCTGT |
| 871 | AATCATCTTTCCTGTTCCAGA |
| 872 | AAAGGCACCTGCATGTGTCTG |
| 873 | AAAGAGGACCTGCGCTCTTGG |
| 874 | AAACGCATATGACTCACCACG |
| 875 | GGAAGAGCTCAGATAGAAA |
| 876 | GGGAGACACGGAAAGTGAA |
| 877 | CACCTGCCATGTGCAGCATGA |
| 878 | GGAGATCACACTGACCTGGCA |
| 879 | GGATTACATCGCCCTGAAAG |
| 880 | GCAGGAGGGTCCGGAGTATT |
| 881 | GGACGGGGAGACACGGAAAG |
| 882 | GAAAGTGAAGGCCCACTCA |
| 883 | GATACCTGGAGAACGGGAAG |
| 884 | GCTGTGGTGGTGCCTTCTGG |
| 885 | GCTACTACAACCAGAGCGAG |
| 886 | GTGGCTCCGCAGATACCTG |
| 887 | GCCAATCAGTGTCGTCGCG |
| 888 | GAGGACCTGCGCTCTTGGA |
| 889 | GTGTGAGACAGCTGCCTTG |
| 890 | GGCACCTGCATGTGTCTGT |
| 891 | TCATCTTTCCTGTTCCAGA |
| 892 | AGGCACCTGCATGTGTCTG |
| 893 | AGAGGACCTGCGCTCTTGG |
| 894 | ACGCATATGACTCACCACG |

In some embodiments, the first sequence and second sequence are separated by a linker, sometimes referred to as a loop. In some embodiments, both the first sequence and the second sequence are encoded by one single-stranded RNA or DNA vector. In some embodiments, the loop is between the first and second sequences. In these embodiments, and the first sequence and the second sequence hybridize to form a duplex region. The first sequence and second sequence are joined by a linker sequence, forming a "hairpin" or "stem-loop" structure. The shRNA can have complementary first sequences and second sequences at opposing ends of a single stranded molecule, so that the molecule can form a duplex region with the complementary sequence portions, and the strands are linked at one end of the duplex region by a linker (i.e. loop sequence). The linker, or loop sequence, can be either a nucleotide or non-nucleotide linker. The linker can interact with the first sequence, and optionally, second sequence through covalent bonds or non-covalent interactions.

Any suitable nucleotide loop sequence is envisaged as within the scope of the disclosure. An shRNA of this disclosure may include a nucleotide, non-nucleotide, or mixed nucleotide/non-nucleotide linker that joins the first sequence of the shRNA to the second sequence of the shRNA. A nucleotide loop sequence can be ≥2 nucleotides in length, for example about 4, 5, 6, 7, 8, 9, 10, 11, 12, 13, 14, or 15 nucleotides in length. Illustrative loop sequences are disclosed in Table 12.

In some embodiments, the shRNA further comprises a 5' flank sequence and a 3' flank sequence. In some embodiments, wherein the 5' flank sequence is joined to the 5' end of the first sequence, and wherein the 3' flank sequence is joined to the 3' end of the second sequence.

Without wishing to be bound by theory, it is thought that flanking shRNA stem loop sequence with 5' and 3' sequences similar to those found in microRNAs can target the shRNA for processing by the endogenous microRNA processing machinery, increasing the effectiveness of shRNA processing. Alternatively, or in addition, flanking sequences may increase shRNA compatibility with polymerase II or polymerase III promoters, leading to more effective regulation of shRNA expression.

In some embodiments, the 5' flank sequence is selected from the sequences set forth in Table 12. Illustrative flank sequence are shown in Table 12.

TABLE 12

Illustrative flank sequences

| SEQ ID NO | 5' Flank Sequence |
|---|---|
| 895 | GG |
| 896 | ACACCAUGUUGCCAGUCUCUAGG |
| 897 | UGAUAGCAAUGUCAGCAGUGCCU |
| 898 | UAUUGCUGUUGACAGUGAGCGAC |

| SEQ ID NO | 3' Flank Sequence |
|---|---|
| 899 | UGGCGUCUGGCCCAACCACAC |
| 900 | GUAAGGUUGACCAUACUCUAC |

In some embodiments, the first and second sequence are present on a single stranded polynucleotide, wherein the first sequence and second sequence are separated by 4, 5, 6, 7, 8, 9, 10, 11, 12, 13, 14, or 15 nucleotides, wherein the 4, 5, 6, 7, 8, 9, 10, 11, 12, 13, 14, or 15 nucleotides form a loop region in the shRNA. In some embodiments, the loop region comprises a sequence selected from the sequences set forth in Table 13

TABLE 13

Illustrative loop region sequences

| SEQ ID NO | Loop Region Sequence |
|---|---|
| 901 | CGAA |
| 902 | UUCAAGA |
| 903 | AUAUUCA |
| 904 | UGUGCUGUC |
| 905 | CUCGAG |
| 906 | CUUCCUGUCAGA |
| 907 | CUUCCCUUUGUCAGA |
| 908 | GUGUUAUUCUUG |
| 909 | GUGUCUUAAUUG |
| 910 | GUGUUAGUCUUG |
| 911 | UCAAGAG |
| 912 | GGACAUCCAGGG |
| 913 | GUGAAGCCACAGAUG |
| 914 | GAUUCUAAAA | shRNAs of the disclosure may be generated exogenously by chemical synthesis, by in vitro transcription, or by cleavage of longer double-stranded RNA with Dicer or another appropriate nuclease with similar activity. Chemically synthesized siRNAs, produced from protected ribonucleoside phosphoramidites using a conventional DNA/RNA synthesizer, may be obtained from commercial suppliers such as Millipore Sigma (Houston, Tex.), Ambion Inc. (Austin, Tex.). Invitrogen (Carlsbad, Calif.), or Dharmacon (Lafayette, Colo.). siRNAs can be purified by extraction with a solvent or resin, precipitation, electrophoresis, chromatography, or a combination thereof, for example. Alternatively, siRNAs may be used with little if any purification to avoid losses due to sample processing.

In some embodiments, shRNAs of the disclosure can be produced using an expression vector into which a nucleic acid encoding the double stranded RNA has been cloned, for example under control of a suitable promoter.

In some embodiments, the immune cell comprises

Pharmaceutical Compositions

The disclosure provides pharmaceutical compositions comprising immune cells comprising the first and second receptors of the disclosure and a pharmaceutically acceptable diluent, carrier or excipient.

Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; and preservatives.

In some embodiments, the immune cell expresses both the first receptor and the second receptor. In some embodiments, at least about 50%, about 55%, about 60%, about 65%, about 70%, about 75%, about 80%, about 85%, about 90%, or about 95% of the immune cells express both the first receptor and the second receptor. In some embodiments, at least 90% of the immune cells express both the first receptor and the second receptor.

Treating Cancer

Provided herein are methods of killing a plurality of cancer cells, or treating cancer, in a subject, comprising administering to the subject a therapeutically effective amount of a composition comprising immune cells comprising the first and second receptors of the disclosure. The immune cells express both receptors in the same cell.

Cancer is a disease in which abnormal cells divide without control and spread to nearby tissue. In some embodiments, the cancer comprises a liquid tumor or a solid tumor. Cancers can arise in virtually an organ in the body, including epithelial tissues. Any cancer wherein a plurality of the cancer cells express the first, activator ligand and do not express the second, inhibitor ligand is envisaged as within the scope of the instant disclosure. For example, EGFR positive cancers that can be treated using the methods described herein include lung cancer, small cell lung cancer, non-small cell lung cancer, pancreatic ductal carcinoma, colorectal cancer, head and neck cancer, esophagus and gastric adenocarcinoma, ovarian cancer, glioblastoma multiforme, cervical squamous cell carcinoma, kidney cancer, papillary kidney cancer, kidney renal clear cell carcinoma, bladder cancer, breast cancer, bile duct cancer, liver cancer, prostate cancer, sarcoma, thyroid cancer, thymus cancer, stomach cancer, or uterine cancer, and all-other EGFR target expressing tumors. The compositions and methods disclosure herein may be used to treating EGFR positive cancers that are relapsed, refractory and/or metastatic.

In some embodiments, the plurality of cancer cells express the target antigen. In some embodiments, the plurality cancer cells of the subject express EGFR. EGFR positive cancers include, but are not limited to, lung cancer, small cell lung cancer, non-small cell lung cancer, pancreatic ductal carcinoma, colorectal cancer, head and neck cancer, esophagus and gastric adenocarcinoma, ovarian cancer, glioblastoma multiforme, cervical squamous cell carcinoma, kidney cancer, papillary kidney cancer, kidney renal clear cell carcinoma, bladder cancer, breast cancer, bile duct cancer, liver cancer, prostate cancer, sarcoma, thyroid cancer, thymus cancer, stomach cancer, or uterine cancer.

In some embodiments, a plurality of cancer cells do not express a polymorphic allele of COLEC12, APCDD1 or CXCL16. In some embodiments, a plurality of cancer cells do not express a non-target antigen. In some embodiments, a plurality of cancer cells do not express HLA-A*02. In some embodiments, the plurality of cancer cells do not express an allelic variant of HLA-A*02. In some embodiments, the plurality of cancer cells do not express HLA-A*01. In some embodiments, the plurality of cancer cells do not express HLA-A*03. In some embodiments, the plurality of cancer cells do not expression HLA-A*11. In some embodiments, the plurality of cancer cells do not express HLA-B*07. In some embodiments, the plurality of cancer cells do not expression HLA-C*07. For example, the cancer cells have lost an allele of COLEC12, APCDD1 or CXCL16, or HLA-A*02 through loss of heterozygosity at that locus.

Administration of the immune cells or pharmaceutical compositions described herein can reduces the size of a tumor in the subject. In some embodiments, the size of the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%, relative to the size of the tumor before administration of the immune cells or pharmaceutical compositions. In some embodiments, the tumor is eliminated.

Administration of the immune cells or pharmaceutical compositions described herein can arrest the growth of a tumor in the subject. For example, the immune cells or pharmaceutical compositions can kill tumor cells, so that the tumor stops growing, or is reduced in size. In some cases, immune cells or pharmaceutical compositions can prevent formation of additional tumors, or reduce the total number of tumors in the subject.

Administration of the immune cells or pharmaceutical compositions described herein can result in selective killing of a cancer cell but not a normal cell in the subject. In some embodiments, about 60% of the cells killed are cancer cells, about 65% of the cells killed are cancer cells, about 70% of the cells killed are cancer cells, about 75% of the cells killed are cancer cells, about 80% of the cells killed are cancer cells, about 85% of the cells killed are cancer cells, about 90% of the cells killed are cancer cells, about 95% of the cells killed are cancer cells, or about 100% of the cells killed are cancer cells.

Administration of the immune cells or pharmaceutical compositions described herein can results in the killing of about 40%, about 50%, about 60%, about 70%, about 80%, about 90% or all of the cancer cells of the subject.

Administration of the immune cells or pharmaceutical compositions described herein can result in fewer side effects for the subject than administration of an otherwise equivalent immune cell comprising the first activator receptor but no second inhibitory receptor. For example, administering the immune cells or pharmaceutical compositions described herein can reduce dose limited toxicity relative to the EGFR CAR, or EGFR TCR administered without the second inhibitory receptor The disclosure provides methods of treating a cancer in a subject comprising: (a) determining the genotype of normal cells and a plurality of cancer cells of the subject at a polymorphic locus selected from the group consisting of a polymorphic locus of COLEC12, a polymorphic locus of APCDD1 and a polymorphic locus of CXCL16, or the HLA-A*02 locus; (b) determining the expression of EGFR in a plurality of cancer cells; and (c) administering a plurality of immune cells to the subject if the normal cells are heterozygous for the polymorphic locus and the plurality of cancer cells are hemizygous for the polymorphic locus or have lost HLA-A*02, and the plurality of cancer cells are EGFR positive, wherein the plurality of immune cells comprise: (i) a first receptor, optionally a chimeric antigen receptor (CAR) or T cell receptor (TCR), comprising an extracellular ligand binding domain specific to EGFR, or a peptide antigen thereof in a complex with a major histocompatibility complex class I (MHC-I); and (ii) a second receptor, optionally an inhibitory chimeric antigen receptor (i.e. inhibitory receptors), comprising an extracellular ligand binding specific to a non-target antigen selected from COLEC12, APCDD1, and CXCL16, or an antigen peptide thereof in a complex with an a major histocompatibility complex class I (MHC-I), or HLA-A*02, wherein the non-target antigen comprises a polymorphism.

Methods of genotyping cancer cells and normal cells from a subject for the presence or absence of SNPs will be readily apparent to persons of ordinary skill in the art. SNP genotyping methods include, inter alia, PCR based methods such as dual-probe TaqMan assays, array based hybridization methods and sequencing.

Methods of measuring the expression of the target antigen in cancer or normal cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods. Methods of measuring loss of heterozygosity in a plurality of cancer cells, include, inter alia, high throughput sequencing of genomic DNA extracted from cancer cells using methods known in the art.

Methods of measuring the expression of the target antigen in cancer or normal cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods.

In some embodiments, the immune cells are T cells.

In some embodiments, the immune cells are allogeneic or autologous.

In some embodiments, the second receptor increases the specificity of the immune cells for the EGFR positive cancer cells compared to immune cells that express the first receptor but do not express the second receptor. In some embodiments, the immune cells have reduced side effects compared to immune cells that express the first receptor but do not express the second receptor.

Treating cancer can result in a reduction in size of a tumor. A reduction in size of a tumor may also be referred to as "tumor regression". Preferably, after treatment, tumor size is reduced by 5% or greater relative to its size prior to treatment; more preferably, tumor size is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Size of a tumor may be measured by any reproducible means of measurement. The size of a tumor may be measured as a diameter of the tumor.

Treating cancer can result in a reduction in tumor volume. Preferably, after treatment, tumor volume is reduced by 5% or greater relative to its size prior to treatment; more preferably, tumor volume is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Tumor volume may be measured by any reproducible means of measurement.

Treating cancer results in a decrease in number of tumors. Preferably, after treatment, tumor number is reduced by 5% or greater relative to number prior to treatment; more preferably, tumor number is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. Number of tumors may be measured by any reproducible means of measurement. The number of tumors may be measured by counting tumors visible to the naked eye or at a specified magnification. Preferably, the specified magnification is 2×, 3×, 4×, 5×, 10×, or 50×.

Treating cancer can result in a decrease in number of metastatic lesions in other tissues or organs distant from the primary tumor site. Preferably, after treatment, the number of metastatic lesions is reduced by 5% or greater relative to number prior to treatment; more preferably, the number of metastatic lesions is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. The number of metastatic lesions may be measured by any reproducible means of measurement. The number of metastatic lesions may be measured by counting metastatic lesions visible to the naked eye or at a specified magnification. Preferably, the specified magnification is 2×, 3×, 4×, 5×, 10×, or 50×.

Treating cancer can result in an increase in average survival time of a population of treated subjects in comparison to a population receiving carrier alone. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in an increase in average survival time of a population of treated subjects in comparison to a population of untreated subjects. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in increase in average survival time of a population of treated subjects in comparison to a population receiving monotherapy with a drug that is not a compound of the present disclosure, or a pharmaceutically acceptable salt, prodrug, metabolite, analog or derivative thereof. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in a decrease in the mortality rate of a population of treated subjects in comparison to a population receiving carrier alone. Treating cancer can result in a decrease in the mortality rate of a population of treated subjects in comparison to an untreated population. Treating cancer can result in a decrease in the mortality rate of a population of treated subjects in comparison to a population receiving monotherapy with a drug that is not a compound of the present disclosure, or a pharmaceutically acceptable salt, prodrug, metabolite, analog or derivative thereof. Preferably, the mortality rate is decreased by more than 2%; more preferably, by more than 5%; more preferably, by more than 10%; and most preferably, by more than 25%. A decrease in the mortality rate of a population of treated subjects may be measured by any reproducible means. A decrease in the mortality rate of a population may be measured, for example, by calculating for a population the average number of disease-related deaths per unit time following initiation of treatment with an active compound. A decrease in the mortality rate of a population may also be measured, for example, by calculating for a population the average number of disease-related deaths per unit time following completion of a first round of treatment with an active compound.

Treating cancer can result in a decrease in tumor growth rate. Preferably, after treatment, tumor growth rate is reduced by at least 5% relative to number prior to treatment; more preferably, tumor growth rate is reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Tumor growth rate may be measured by any reproducible means of measurement. Tumor growth rate can be measured according to a change in tumor diameter per unit time.

Treating cancer can result in a decrease in tumor regrowth. Preferably, after treatment, tumor regrowth is less than 5%; more preferably, tumor regrowth is less than 10%; more preferably, less than 20%; more preferably, less than 30%; more preferably, less than 40%; more preferably, less than 50%; even more preferably, less than 50%; and most preferably, less than 75%. Tumor regrowth may be measured by any reproducible means of measurement. Tumor regrowth is measured, for example, by measuring an increase in the diameter of a tumor after a prior tumor shrinkage that followed treatment. A decrease in tumor regrowth is indicated by failure of tumors to reoccur after treatment has stopped.

Treating or preventing a cancer can result in a reduction in the rate of cellular proliferation. Preferably, after treatment, the rate of cellular proliferation is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The rate of cellular proliferation may be measured by any reproducible means of measurement. The rate of cellular proliferation is measured, for example, by measuring the number of dividing cells in a tissue sample per unit time.

Treating or preventing cancer can result in a reduction in the proportion of proliferating cells. Preferably, after treatment, the proportion of proliferating cells is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The proportion of proliferating cells may be measured by any reproducible means of measurement. Preferably, the proportion of proliferating cells is measured, for example, by quantifying the number of dividing cells relative to the number of nondividing cells in a tissue sample. The proportion of proliferating cells can be equivalent to the mitotic index.

Treating or preventing cancer can result in a decrease in size of an area or zone of cellular proliferation. Preferably, after treatment, size of an area or zone of cellular proliferation is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Size of an area or zone of cellular proliferation may be measured by any reproducible means of measurement. The size of an area or zone of cellular proliferation may be measured as a diameter or width of an area or zone of cellular proliferation.

Treating or preventing cancer can result in a decrease in the number or proportion of cells having an abnormal appearance or morphology. Preferably, after treatment, the number of cells having an abnormal morphology is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. An abnormal cellular appearance or morphology may be measured by any reproducible means of measurement. An abnormal cellular morphology can be measured by microscopy, e.g., using an inverted tissue culture microscope. An abnormal cellular morphology can take the form of nuclear pleiomorphism.

Dosage and Administration

The immune cells and of the present disclosure may be administered in a number of ways depending upon whether local or systemic treatment is desired.

In general, administration may be parenteral.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al and U.S. Pat. No. 4,690,915 to Rosenberg.

The compositions of the disclosure are suitable for parenteral administration. As used herein, "parenteral administration" of a pharmaceutical composition includes any route of administration characterized by physical breaching of a tissue of a subject and administration of the pharmaceutical composition through the breach in the tissue, thus generally resulting in the direct administration into the blood stream, into muscle, or into an internal organ. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intratumoral, intrasynovial injection or infusions; and kidney dialytic infusion techniques. In some embodiments, parenteral administration of the compositions of the present disclosure comprises intravenous or intraarterial administration.

The disclosure provides pharmaceutical compositions comprising a plurality of immune cells of the disclosure, and a pharmaceutically acceptable carrier, diluent or excipient.

Formulations of a pharmaceutical composition suitable for parenteral administration typically generally comprise of immune cells combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampoules or in multi-dose containers containing a preservative. Formulations for parenteral administration include, but are not limited to, suspensions, solutions, emulsions in oily or aqueous vehicles, pastes, and the like. Such formulations may further comprise one or more additional ingredients including, but not limited to, suspending, stabilizing, or dispersing agents. Parenteral formulations also include aqueous solutions which may contain excipients such as salts, carbohydrates and buffering agents. Exemplary parenteral administration forms include solutions or suspensions in sterile aqueous solutions, for example, aqueous propylene glycol or dextrose solutions. Such dosage forms can be suitably buffered, if desired. Formulations for parenteral administration may be formulated to be immediate and/or modified release. Modified release formulations include delayed-, sustained-, pulsed-, controlled-, targeted and programmed release.

In some embodiments, the formulated composition comprising the immune cells is suitable for administration via injection. In some embodiments, the formulated composition comprising the immune cells is suitable for administration via infusion.

The pharmaceutical compositions of the present disclosure, which may conveniently be presented in unit dosage form, may be prepared according to conventional techniques well known in the pharmaceutical industry. Such techniques include the step of bringing into association the immune cells with the pharmaceutical carrier(s) or excipient(s), such as liquid carriers.

Aqueous suspensions may further contain substances that increase the viscosity of the suspension including, for example, sodium carboxymethylcellulose, sorbitol and/or dextran. The suspension may also contain stabilizers.

The compositions of the present disclosure may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, preservatives, antioxidants, opacifiers, thickening agents and stabilizers. However, such materials, when added, should not unduly interfere with the biological activities of the immune cells of the compositions of the present disclosure.

The formulation or composition may also contain more than one active ingredient useful for the particular indication, disease, or condition being treated with the immune cells, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

Administration can be effected in one dose, continuously or intermittently throughout the course of treatment. Single or multiple administrations can be carried out with the dose level and pattern being selected by the treating physician.

The pharmaceutical composition in some embodiments contains the immune cells in amounts effective to treat or prevent a cancer, such as a therapeutically effective or prophylactically effective amount. Therapeutic or prophylactic efficacy in some embodiments is monitored by periodic assessment of treated subjects. For repeated administrations over days, weeks or months, depending on the condition, the treatment can be repeated until a desired suppression of cancer signs or symptoms occurs. However, other dosage regimens may be useful and can be determined. The desired dosage can be delivered by a single bolus administration or infusion of the composition or by multiple bolus administrations or infusions of the composition.

The cells or population of cells can be administrated in one or more doses. In some embodiments, an effective amount of cells can be administrated as a single dose. In some embodiments, an effective amount of cells can be administrated as more than one doses over a period time. Timing of administration is within the judgment of a managing physician and depends on the clinical condition of the patient.

The cells or population of cells may be obtained from any source, such as a blood bank or a donor, or the patient themselves.

An effective amount means an amount which provides a therapeutic or prophylactic benefit. The dosage administered will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection within a tumor.

For purposes of the disclosure, an assay, which comprises, for example, comparing the extent to which target cells are lysed or one or more cytokines are secreted by immune cells expressing the receptors, upon administration of a given dose of such immune cells to a mammal, among a set of mammals of which is each given a different dose of the immune cells, can be used to determine a starting dose to be administered to a mammal.

In some embodiments, the cells are administered as part of a combination treatment, such as simultaneously with or sequentially with, in any order, another therapeutic intervention, such as an antibody or engineered cell or receptor or agent, such as a cytotoxic or therapeutic agent. The immune cells of the disclosure are in some embodiments co-administered with one or more additional therapeutic agents or in connection with another therapeutic intervention, either simultaneously or sequentially in any order. In some contexts, the immune cells are co-administered with another therapy sufficiently close in time such that the immune cell populations enhance the effect of one or more additional therapeutic agents, or vice versa. In some embodiments, the immune cells are administered prior to the one or more additional therapeutic agents. In some embodiments, the immune cells are administered after to the one or more additional therapeutic agents.

In embodiments, a lymphodepleting chemotherapy is administered to the subject prior to, concurrently with, or after administration (e.g., infusion) of adoptive immune cells. In an example, the lymphodepleting chemotherapy is administered to the subject prior to administration of the immune cells. For example, the lymphodepleting chemotherapy ends 1-4 days (e.g., 1, 2, 3, or 4 days) prior to adoptive cell infusion. In embodiments, multiple doses of adoptive cells are administered, e.g., as described herein. In embodiments, a lymphodepleting chemotherapy is administered to the subject prior to, concurrently with, or after administration (e.g., infusion) of the immune cells described herein. Examples of lymphodepletion include, but may not be limited to, nonmyeloablative lymphodepleting chemotherapy, myeloablative lymphodepleting chemotherapy, total body irradiation, etc. Examples of lymphodepleting agents include, but are not limited to, antithymocyte globulin, anti-CD3 antibodies, anti-CD4 antibodies, anti-CD8 antibodies, anti-CD52 antibodies, anti-CD2 antibodies, TCRαβ blockers, anti-CD20 antibodies, anti-CD19 antibodies, Bortezomib, rituximab, anti-CD 154 antibodies, rapamycin, CD3 immunotoxin, fludarabine, cyclophosphamide, busulfan, melphalan, Mabthera, Tacrolimus, alefacept, alemtuzumab, OKT3, OKT4, OKT8, OKT11, fingolimod, anti-CD40 antibodies, anti-BR3 antibodies, Campath-1H, anti-CD25 antibodies, calcineurin inhibitors, mycophenolate, and steroids, which may be used alone or in combination. As a further example, a lymphodepletion regimen can include, administration of alemtuzumab, cyclophosphamide, benduamustin, rituximab, pentostatin, and/or fludarabine. Lymphodepletion regimen can be administered in one or more cycles until the desired outcome of reduced circulating immune cells. In some embodiments, the lymphodepletion comprises administering an agent that specifically targets, and reduces or eliminates CD52+ cells in the subject, and the immune cells are modified to reduce or eliminate CD52 expression.

In some embodiments, an immune stimulating therapy is administered to the subject prior to, concurrently with, or after administration (e.g. infusion) of adoptive immune cells. In some embodiments, the immune stimulating therapy comprises homeostatic cytokines. In some embodiments, the immune stimulating therapy comprises immune-stimulatory molecules. In some embodiments, the immune stimulating therapy comprises IL-2, IL-7, IL-12, IL-15, IL-21, IL-9, or a functional fragment thereof. In some embodiments, the immune stimulating therapy comprises IL-2, IL-7, IL-12, IL-15, IL-21, IL-9, or combinations thereof. In some embodiments, the immune stimulating therapy comprises IL-2, or a functional fragment thereof.

Methods for adoptive cell therapy using autologous cells includes isolating immune cells from patient blood, performing a series of modifications on the isolated cells including transducing the cells with one or more vectors encoding the dual receptor system described herein, and administering the cells to a patient. Providing immune cells from a subject suffering from or at risk for cancer or a hematological malignancy requires isolation of immune cell from the patient's blood, and can be accomplished through methods known in the art, for example, by leukapheresis. During leukapheresis, blood from a subject is extracted and the peripheral blood mononuclear cells (PBMCs) are separated, and the remainder of the blood is returned to the subject's circulation. The PBMCs are stored either frozen or cryopreserved as a sample of immune cells and provided for further processing steps, such as, e.g. the modifications described herein.

In some embodiments, the method of treating a subject described herein comprises modifications to immune cells from the subject comprising a series of modifications comprising enrichment and/or depletion, activation, genetic modification, expansion, formulation, and cryopreservation.

The disclosure provides enrichment and/or depletion steps that can be, for example, washing and fractionating methods known in the art for preparation of subject PBMCs for downstream procedures, e.g. the modifications described herein. For example, without limitation, methods can include devices to remove gross red blood cells and platelet contaminants, systems for size-based cell fractionation for the depletion of monocytes and the isolation of lymphocytes, and/or systems that allow the enrichment or depletion of specific subsets of T cells, such as, e.g. CD4+, CD8+, CD25+, or CD62L+ T cells. Following the enrichment steps, a target sub-population of immune cells will be isolated from the subject PMBCs for further processing. Those skilled in the art will appreciate that enrichment steps, as provided herein, may also encompass any newly discovered method, device, reagent or combination thereof.

The disclosure provides activation steps that can be any method known in the art to induce activation of immune cells, e.g. T cells, required for their ex vivo expansion. Immune cell activation can be achieved, for example, by culturing the subject immune cells in the presence of dendritic cells, culturing the subject immune cells in the presence of artificial antigen-presenting cells (AAPCs), or culturing the immune cells in the presence of irradiated K562-derived AAPCs. Other methods for activating subject immune cells can be, for example, culturing the immune cells in the presence of isolated activating factors and compositions, e.g. beads, surfaces, or particles functionalized with activating factors. Activating factors can include, for example, antibodies, e.g. anti-CD3 and/or anti-CD28 antibodies. Activating factors can also be, for example, cytokines, e.g. interleukin (IL)-2 or IL-21. Activating factors can also be costimulatory molecules, such as, for example, CD40, CD40L, CD70, CD80, CD83, CD86, CD137L, ICOSL, GITRL, and CD134L. Those skilled in the art will appreciate that activating factors, as provided herein, may also encompass any newly discovered activating factor, reagent, composition, or combination thereof that can activate immune cells.

The disclosure provides genetic modification steps for modifying the subject immune cells. In some embodiments, the genetic modification comprises transducing the immune cell with a vector comprising a shRNA described herein complementary to B2M or HLA-A. In some embodiments, the genetic modification comprises modifying the genome of the immune cells to induce mutations in B2M or HLA-A using CRISPR/Cas mediated genome engineering. In some embodiments, the method comprises transducing the immune cell with one or more vectors encoding the activator and inhibitory receptors, thereby producing immune cells expressing the activator and inhibitory receptors.

The disclosure provides expansion steps for the genetically modified subject immune cells. Genetically modified subject immune cells can be expanded in any immune cell expansion system known in the art to generate therapeutic doses of immune cells for administration. For example, bioreactor bags for use in a system comprising controller pumps, and probes that allow for automatic feeding and waste removal can be used for immune cell expansion. Cell culture flasks with gas-permeable membranes at the base may be used for immune cell expansion. Any such system known in the art that enables expansion of immune cells for clinical use is encompassed by the expansion step provided herein. Immune cells are expanded in culture systems in media formulated specifically for expansion. Expansion can also be facilitated by culturing the immune cell of the disclosure in the presence of activation factors as described herein. Those skilled in the art will appreciate that expansion steps, as provided herein, may also encompass any newly discovered culture systems, media, or activating factors that can be used to expand immune cells.

The disclosure provides formulation and cryopreservation steps for the expanded genetically modified subject immune cells. Formulation steps provided include, for example, washing away excess components used in the preparation and expansion of immune cells of the methods of treatment described herein. Any pharmaceutically acceptable formulation medium or wash buffer compatible with immune cell known in the art may be used to wash, dilute/concentration immune cells, and prepare doses for administration. Formulation medium can be acceptable for administration of the immune cells, such as, for example crystalloid solutions for intravenous infusion.

Cryopreservation can optionally be used to store immune cells long-term. Cryopreservation can be achieved using known methods in the art, including for example, storing cells in a cryopreservation medium containing cryopreservation components. Cryopreservation components can include, for example, dimethyl sulfoxide or glycerol. Immune cells stored in cryopreservation medium can be cryopreserved by reducing the storage temperature to −80° C. to −196° C.

In some embodiments, the method of treatment comprises determining the HLA germline type of the subject. In some embodiments, the HLA germline type is determined in bone marrow.

In some embodiments, the method of treatment comprises determining the level of expression of EGFR. In some embodiments, the level of expression of EGFR is determined in tumor tissue samples from the subject. In some embodiments, the expression level of EGFR is determined using next generation sequencing. In some embodiments, the expression level of EGFR is determined using RNA sequencing. In some embodiments, the level of EGFR is determined using immunohistochemistry.

In some embodiments, the method of treatment comprises administering a therapeutically effective dose of immune cells comprising an HLA-A*02 inhibitory receptor to a subject in need thereof, wherein the subject is determined to be HLA germline HLA-A*02 heterozygous and have cancer cells with loss of HLA-A*02. In some embodiments, the method of treatment comprises administering a therapeutically effective dose of immune cells comprising an HLA-A*01 inhibitory receptor to a subject in need thereof, wherein the subject is determined to be HLA germline HLA-A*01 heterozygous and have cancer cells with loss of HLA-A*01. In some embodiments, the method of treatment comprises administering a therapeutically effective dose of immune cells comprising an HLA-A*03 to a subject in need thereof, wherein the subject is determined to be HLA germline HLA-A*03 heterozygous and have cancer cells with loss of HLA-A*03. In some embodiments, the method of treatment comprises administering a therapeutically effective dose of immune cells comprising an HLA-A*07 inhibitory receptor to a subject in need thereof, wherein the subject is determined to be HLA germline HLA-A*07 heterozygous and have cancer cells with loss of HLA-A*07. In some embodiments, the method of treatment comprises administering a therapeutically effective dose of immune cells comprising an HLA-C*07 inhibitory receptor to a subject in need thereof, wherein the subject is determined to be HLA germline HLA-C*07 heterozygous and have cancer cells with and loss of HLA-C*07. In some embodiments, the method of treatment comprises administering a therapeutically effective dose of immune cells comprising an HLA-B*07 inhibitory receptor in a subject in need thereof, wherein the subject is determined to be HLA germline HLA-B*07 heterozygous and have cancer cells with loss of HLA-B*07.

In various embodiments, the disclosure provides method of treatment of heterozygous HLA-A*02 patients with malignancies that express EGFR and have lost HLA-A*02 expression; and/or of treatment of heterozygous HLA-A*02 adult patients with recurrent unresectable or metastatic solid tumors that express EGFR and have lost HLA-A*02 expression.

In some embodiments, a therapeutically effective dose of the immune cells described herein are administered. In some embodiments, the immune cells of the disclosure are administered by intravenous injection. In some embodiments, the immune cells of the disclosure are administered by intraperitoneal injection. In some embodiments, a therapeutically effective dose comprises about $0.5 \times 10^6$ cells, about $1 \times 10^6$ cells, about $2 \times 10^6$ cells, about $3 \times 10^6$ cells, $4 \times 10^6$ cells, about $5 \times 10^6$ cells, about $6 \times 10^6$ cells, about $7 \times 10^6$ cells, about $8 \times 10^6$ cells, about $9 \times 10^6$ cells, about $1 \times 10^7$ cells, about $2 \times 10^7$, about $3 \times 10^7$, about $4 \times 10^7$, about $5 \times 10^7$, about $6 \times 10^7$, about $7 \times 10^7$, about $8 \times 10^7$, about $9 \times 10^7$, about $1 \times 10^8$ cells, about $2 \times 10^8$ cells, about $3 \times 10^8$ cells, about $4 \times 10^8$ cells, about $5 \times 10^8$ cells, about $6 \times 10^8$ cells, about $7 \times 10^8$ cells, about $8 \times 10^8$ cells, about $9 \times 10^8$ cells, about $1 \times 10^9$ cells, about $2 \times 10^9$ cells, about $3 \times 10^9$ cells, about $3 \times 10^9$ cells, about $4 \times 10^9$ cells, about $5 \times 10^9$ cells, about $5 \times 10^9$ cells, about $6 \times 10^9$ cells, about $7 \times 10^9$ cells, about $8 \times 10^9$ cells, about $9 \times 10^9$ cells, about $1 \times 10^{10}$ cells, about $2 \times 10^{10}$ cells, about $3 \times 10^{10}$ cells, about $4 \times 10^{10}$ cells, about $5 \times 10^{10}$ cells, about $6 \times 10^{10}$ cells, about $7 \times 10^{10}$ cells, about $8 \times 10^{10}$ cells, or about $9 \times 10^{10}$ cells.

In some embodiments, a therapeutically effective dose comprises about $0.5 \times 10^6$ cells to about $9 \times 10^{10}$ cells, about $1 \times 10^6$ cells to about $5 \times 10^{10}$ cells, about $2 \times 10^6$ cells to about $5 \times 10^9$ cells, about $3 \times 10^6$ cells to about $5 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^9$ cells, about $1 \times 10^6$ cells to about $5 \times 10^9$ cells, about $2 \times 10^6$ cells to about $5 \times 10^9$ cells, about $3 \times 10^6$ cells to about $4 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^8$ cells, about $1 \times 10^6$ cells to about $5 \times 10^8$ cells, about $2 \times 10^6$ cells to about $5 \times 10^8$ cells, about $3 \times 10^6$ cells to about $4 \times 10^8$ cells, about $4 \times 10^6$ cells to about $3 \times 10^8$ cells, about $5 \times 10^6$ cells to about $2 \times 10^8$ cells, about $6 \times 10^6$ cells to about $1 \times 10^8$ cells, about $7 \times 10^6$ cells to about $9 \times 10^8$ cells, about $8 \times 10^6$ cells to about $8 \times 10^8$ cells, about $9 \times 10^6$ cells to about $7 \times 10^8$ cells, about $1 \times 10^7$ cells to about $6 \times 10^8$ cells, about $2 \times 10^7$ cells to about $5 \times 10^8$ cells, about $7 \times 10^6$ cells to about $9 \times 10^7$ cells, about $8 \times 10^6$ cells to about $8 \times 10^7$ cells, about $9 \times 10^6$ cells to about $7 \times 10^7$ cells, about $1 \times 10^7$ cells to about $6 \times 10^7$ cells, or about $2 \times 10^7$ cells to about $5 \times 10^7$ cells.

In some embodiments, a therapeutically effective dose comprises about $0.5 \times 10^5$ cells to about $9 \times 10^{10}$ cells. In some embodiments, a therapeutically effective dose comprises about $0.5 \times 10^6$ cells to about $1 \times 10^{10}$ cells. In some embodiments, a therapeutically effective dose comprises about $0.5 \times 10^6$ cells to about $5 \times 10^9$ cells. In some embodiments, a therapeutically effective dose comprises about $0.5 \times 10^6$ cells to about $1 \times 10^9$ cells. In some embodiments, a therapeutically effective dose comprises about $0.5 \times 10^6$ cells to about $6 \times 10^8$ cells. In some embodiments, a therapeutically effective dose comprises about $0.5 \times 10^6$ cells to about $9 \times 10^{10}$ cells. In some embodiments, a therapeutically effective dose comprises about $0.5 \times 10^7$ cells to about $1 \times 10^{10}$ cells. In some embodiments, a therapeutically effective dose comprises about $0.5 \times 10^7$ cells to about $5 \times 10^9$ cells. In some embodiments, a therapeutically effective dose comprises about $0.5 \times 10^7$ cells to about $1 \times 10^9$ cells. In some embodiments, a therapeutically effective dose comprises about $0.5 \times 10^7$ cells to about $6 \times 10^8$ cells. In some embodiments, a therapeutically effective dose comprises about $0.5 \times 10^8$ cells to about $9 \times 10^{10}$ cells. In some embodiments, a therapeutically effective dose comprises about $0.5 \times 10^8$ cells to about $1 \times 10^{10}$ cells. In some embodiments, a therapeutically effective dose comprises about $0.5 \times 10^8$ cells to about $5 \times 10^9$ cells. In some embodiments, a therapeutically effective dose comprises about $0.5 \times 10^8$ cells to about $1 \times 10^9$ cells. The term "about" as referred to in a therapeutically dose, can be, for example, ±$0.5 \times 10^6$ cells, ±$0.5 \times 10^7$ cells, or $0.5 \times 10^8$ cells Kits and Articles of Manufacture The disclosure provides kits and articles of manufacture comprising the polynucleotides and vectors encoding the receptors described herein, and immune cells comprising the receptors described herein. In some embodiments, the kit comprises articles such as vials, syringes and instructions for use.

In some embodiments, the kit comprises a polynucleotide or vector comprising a sequence encoding one or more receptors of the disclosure.

In some embodiments, the kit comprises a plurality of immune cells comprising the first and second receptors as described herein. In some embodiments, the plurality of immune cells comprises a plurality of T cells.

In some embodiments, the kit further comprises instructions for use.

ENUMERATED EMBODIMENTS

Embodiment 1. An immune cell, comprising.
- a.) a first receptor, comprising an extracellular ligand binding domain specific to Epidermal Growth Factor Receptor (EGFR); and
- b.) a second receptor, comprising an extracellular ligand binding domain specific to a non-target antigen lost in EGFR+ cancer due to loss of heterozygosity, wherein the first receptor is an activator receptor responsive to EGFR; and wherein the second receptor is an inhibitory receptor responsive to the non-target antigen.

Embodiment 2. The immune cell of Embodiment 1, wherein the extracellular ligand binding domain of the second receptor specifically binds an allelic variant of an MHC protein.

Embodiment 3. The immune cell of Embodiment 1, wherein the extracellular ligand binding domain of the second receptor specifically binds an allelic variant of an HLA-A, HLA-B, or HLA-C protein.

Embodiment 4. The immune cell of Embodiment 1, wherein the extracellular ligand binding domain of the second receptor specifically binds HLA-A*02.

Embodiment 5. The immune cell of Embodiment 1, wherein the extracellular ligand binding domain of the second receptor specifically binds HLA-A*01, HLA-A*03, HLA-A*11, HLA-C*07, or HLA-B*07.

Embodiment 6. The immune cell of any one of Embodiments 3-5, wherein the extracellular ligand binding domain of the second receptor comprises complementarity determining regions (CDRs) CDR-L1, CDR-L2, CDR-L3, CDR-H1, CDR-H2, CDR-H3 as disclosed Table 5; or CDR sequences having at most 1, 2, or 3 substitutions, deletions, or insertion relative to the CDRs of Table 5.

Embodiment 7. The immune cell of any one of Embodiments 3-5, wherein the extracellular ligand binding domain of the second receptor comprises complementarity determining regions (CDRs) CDR-L1, CDR-L2, CDR-L3, CDR-H1, CDR-H2, CDR-H3 of SEQ ID NOs: 101-106 or of SEQ ID NOs: 106-112; or CDR sequences having at most 1, 2, or 3 substitutions, deletions, or insertion relative to the CDRs of Table 5.

Embodiment 8. The immune cell of any one of Embodiments 3-5, wherein the extracellular ligand binding domain of the second receptor comprises a polypeptide sequence selected from the polypeptide sequence disclosed in Table 4; or a sequence having at least 85%, at least 90%, at least 95%, at least 97% or at least 99% identity thereto.

Embodiment 9. The immune cell of Embodiment 4, wherein the extracellular ligand binding domain of the second receptor comprises any one of SEQ ID NOs: 89-100; or a sequence having at least 85%, at least 90%, at least 95%, at least 97% or at least 99% identity thereto.

Embodiment 10. The immune cell of any one of Embodiments 1-9, wherein the first receptor is a chimeric antigen receptor (CAR).

Embodiment 11. The immune cell of any one of Embodiments 1-10, wherein the extracellular ligand binding domain of the first receptor comprises a variable heavy (VH) portion comprising a set of heavy chain complementarity determining regions (HC-CDRs) selected from the group of sequences set forth Table 3; and/or a variable light (VL) portion comprising a set of light chain complementarity determining regions (LC-CDRs) from the group of sequences set forth in Table 3; or CDR sequences having at most 1, 2, 3, 4 substitutions, insertions, or deletions in each CDR.

Embodiment 12. The immune cell of any one of Embodiments 1-11, wherein the extracellular ligand binding domain of the first receptor comprises a variable heavy (VH) portion having a sequence selected from the VH sequence set forth in Table 2; and/or a variable light (VL) portion comprising a sequence set forth in Table 2; or sequences having at least 70%, at least 85%, at least 90%, or at least 95% identity thereto.

Embodiment 13. The immune cell of any one of Embodiments 1-12, wherein the extracellular ligand binding domain of the first receptor comprising a sequence selected from the group of sequences set forth in Table 1; or a sequence having at least 85%, at least 90%, at least 95%, at least 97%, or at least 99% identity thereto.

Embodiment 14. The immune cell of any one of Embodiments 1-13, wherein the extracellular ligand binding domain of the first receptor comprises an scFv sequence selected from the group consisting of SEQ ID NO: 9-18; or a sequence having at least 85%, at least 90%, at least 95%, at least 97% or at least 99% identity thereto.

Embodiment 15. The immune cell of any one of Embodiments 1-14, wherein the second receptor comprises a LILRB1 intracellular domain or a functional variant thereof.

Embodiment 16. The immune cell of Embodiment 15, wherein the LILRB1 intracellular domain comprises a sequence at least 90%, at least 95%, at least 97%, at least 99%, or is identical to SEQ ID NO: 129.

Embodiment 17. The immune cell of any one of Embodiments 1-16, wherein the second receptor comprises a LILRB1 transmembrane domain or a functional variant thereof.

Embodiment 18. The immune cell of Embodiment 17, wherein the LILRB1 transmembrane domain or a functional variant thereof comprises a sequence at least 90%, at least 95%, at least 97%, at least 99% or is identical to SEQ ID NO: 133.

Embodiment 19. The immune cell of any one of Embodiments 1-18, wherein the second receptor comprises a LILRB1 hinge domain or functional variant thereof.

Embodiment 20. The immune cell of Embodiment 19, wherein the LILRB1 hinge domain comprises a sequence at least 90%, at least 95%, at least 97%, at least 99% or is identical to SEQ ID NO: 132, SEQ ID NO: 125, SEQ ID NO: 126.

Embodiment 21. The immune cell of any one of Embodiments 1-20, wherein the second receptor comprises a LILRB1 intracellular domain, a LILRB1 transmembrane domain, a LILRB1 hinge domain, a functional variant of any of these, or combinations thereof.

Embodiment 22. The immune cell of Embodiment 21, wherein the LILRB1 intracellular domain and LILRB1 transmembrane domain comprises SEQ ID NO: 128 or a sequence at least 95% identical to SEQ ID NO: 128.

Embodiment 23. The immune cell of any one of Embodiments 1-22, wherein the EGFR+ cancer cell is a lung cancer cell, a small cell lung cancer cell, a non-small cell lung cancer cell, a pancreatic ductal carcinoma cell, a colorectal cancer cell, a head and neck cancer cell, a esophagus and gastric adenocarcinoma cell, an ovarian cancer cell, a glioblastoma multiforme cell, a cervical squamous cell carcinoma cell, a kidney cancer cell, a papillary kidney cancer cell, a kidney renal clear cell carcinoma cell, a bladder cancer cell, a breast cancer cell, a bile duct cancer cell, a liver cancer cell, a prostate cancer cell, a sarcoma cell, a thyroid cancer cell, a thymus cancer cell, a stomach cancer cell, or a uterine cancer cell.

Embodiment 24. The immune cell of Embodiment 23, wherein the EGFR+ cancer cell is a lung cancer cell.

Embodiment 25. The immune cell of any one of Embodiments 1-24, wherein the EGFR+ cancer cell is an EGFR+/HLA-A*02− cancer cell that does not express HLA-A*02; or a cancer cell derived from an HLA-A*02+ individual which does not express HLA-A*02.

Embodiment 26. The immune cell of Embodiment 25, wherein the EGFR+/HLA-A*02-cancer cell is derived from an EGFR+/HLA-A*02+ cell by loss of heterozygosity at HLA-A leading to loss of HLA-A*02.

Embodiment 27. The immune cell of any one of Embodiments 1-26, wherein the first receptor and the second receptor together specifically activate the immune cell in the presence of the EGFR/HLA-A*02− cancer cell having loss of heterozygosity.

Embodiment 28. The immune cell of any one of Embodiments 1-27, wherein the first receptor and the second receptor together do not specifically activate the immune cell in the presence of an EGFR+ cell that has not lost HLA-A*02 by loss of heterozygosity.

Embodiment 29. The immune cell of any one of Embodiments 1-28, wherein the immune cell is a T cell, macrophage, NK cell, iNKT cell, or a gamma delta T cell.

Embodiment 30. The immune cell of Embodiment 29, wherein the T cell is a CD8+CD4− T cell.

Embodiment 31. The immune cell of any one of Embodiments 1-30, wherein expression and/or function of an MHC Class I gene has been reduced or eliminated.

Embodiment 32. The immune cell of Embodiment 30, wherein the MHC Class I gene is beta-2-microglobulin (B2M).

Embodiment 33. The immune cell of Embodiment 32, further comprising a polynucleotide comprising an interfering RNA, the interfering RNA comprising a sequence complementary to a sequence of a B2M mRNA (SEQ ID NO: 172).

Embodiment 34. The immune cell of Embodiment 33, wherein the interfering RNA is capable of inducing RNAi-mediated degradation of the B2M mRNA.

Embodiment 35. The immune cell of Embodiment 33, wherein the interfering RNA is a short hairpin RNA (shRNA).

Embodiment 36. The immune cell of Embodiment 35, wherein the shRNA comprises:
  a.) a first sequence, having from 5' end to 3' end a sequence complementary to a sequence of the B2M mRNA; and
  b.) a second sequence, having from 5' end to 3' end a sequence complementary to the first sequence,
    wherein the first sequence and the second sequence form the shRNA.

Embodiment 37. The immune cell of Embodiment 32, comprising one or more modifications to a sequence encoding B2M (SEQ ID NO: 170), wherein the one or more modifications reduce the expression and/or eliminate the function of B2M.

Embodiment 38. The immune cell of Embodiment 37, wherein the one or more modifications comprise one or more inactivating mutations of the endogenous gene encoding B2M.

Embodiment 39. The immune cell of Embodiment 38, wherein the one or more inactivating mutations comprise a deletion, an insertion, a substitution, or a frameshift mutation.

Embodiment 40. The immune cell of any one of Embodiments 38-39, wherein the one or more inactivating mutations are introduced with a nucleic acid guided endonuclease in a complex with at least one guide nucleic acid (gNA) that specifically targets a sequence of the endogenous gene encoding B2M (SEQ ID NO: 170).

Embodiment 41. The immune cell of Embodiment 31, wherein the MHC Class I gene is HLA-A*02.

Embodiment 42. The immune cell of Embodiment 41, further comprising a polynucleotide comprising an interfering RNA, comprising a sequence complementary to a sequence of an HLA-A*02 mRNA (SEQ ID NO: 171).

Embodiment 43. The immune cell of Embodiment 42, wherein the interfering RNA is capable of inducing RNA interference (RNAi)-mediated degradation of the HLA-A*02 mRNA.

Embodiment 44. The immune cell of Embodiment 43, wherein the interfering RNA is a short hairpin RNA (shRNA) comprising:
  a.) a first sequence, having from 5' end to 3' end a sequence complementary to a sequence of the HLA-A*02 mRNA; and
  b.) a second sequence, having from 5' end to 3' end a sequence complementary to the first sequence,
    wherein the first sequence and the second sequence form the shRNA.

Embodiment 45. The immune cell of Embodiment 41, comprising one or more modifications to a sequence of an endogenous gene encoding HLA-A*02 (SEQ ID NO: 169), wherein the one or modifications reduce the expression and/or eliminate the function of HLA-A*02.

Embodiment 46. The immune cell of Embodiment 45, wherein the one or more modifications comprise one or more inactivating mutations of the endogenous gene encoding HLA-A*02.

Embodiment 47. The immune cell of Embodiment 45 or Embodiment 46, wherein the one or more inactivating mutations are introduced with a nucleic acid guided endonuclease in a complex with at least one guide nucleic acid (gNA) that specifically targets a sequence of the endogenous gene encoding HLA-A*02.

Embodiment 48. The immune cell of Embodiment 1, wherein:
  a.) the first receptor comprises SEQ ID NO: 177, or a sequence sharing at least 75%, at least 80%, at least 85%, at least 90%, at least 95%, or at least 98% identity thereto; and
  b.) the second receptor comprises SEQ ID NO: 174 or a sequence sharing at least 75%, at least 80%, at least 85%, at least 90%, at least 95%, or at least 98% identity thereto.

Embodiment 49. The immune cell of Embodiment 1, wherein:
  a.) the first receptor comprises SEQ ID NO: 177, or a sequence sharing at least 75%, at least 80%, at least 85%, at least 90%, at least 95%, or at least 98% identity thereto; and b.) the second receptor comprises SEQ ID NO: 173, or a sequence sharing at least 75%, at least 80%, at least 85%, at least 90%, at least 95%, or at least 98% identity thereto.

Embodiment 50. The immune cell of Embodiment 1, wherein:
a.) the first receptor comprises SEQ ID NO: 175, or a sequence sharing at least 75%, at least 80%, at least 85%, at least 90%, at least 95%, or at least 98% identity thereto; and
b.) the second receptor comprises SEQ ID NO: 174, or a sequence sharing at least 75%, at least 80%, at least 85%, at least 90%, at least 95%, or at least 98% identity thereto.

Embodiment 51. The immune cell of Embodiment 1, wherein:
a.) the first receptor comprises SEQ ID NO: 175, or a sequence sharing at least 75%, at least 80%, at least 85%, at least 90%, at least 95%, or at least 98% identity thereto; and
b.) the second receptor comprises SEQ ID NO: 173, or a sequence sharing at least 75%, at least 80%, at least 85%, at least 90%, at least 95%, or at least 98% identity thereto.

Embodiment 52. The immune cell of Embodiment 1, wherein:
a.) the first receptor comprises SEQ ID NO: 176, or a sequence sharing at least 75%, at least 80%, at least 85%, at least 90%, at least 95%, or at least 98% identity thereto; and
b.) the second receptor comprises SEQ ID NO: 173, or a sequence sharing at least 75%, at least 80%, at least 85%, at least 90%, at least 95%, or at least 98% identity thereto.

Embodiment 53. The immune cell of Embodiment 1, wherein:
a.) the first receptor comprises SEQ ID NO: 176, or a sequence sharing at least 75%, at least 80%, at least 85%, at least 90%, at least 95%, or at least 98% identity thereto; and
b.) the second receptor comprises SEQ ID NO: 173, or a sequence sharing at least 75%, at least 80%, at least 85%, at least 90%, at least 95%, or at least 98% identity thereto.

Embodiment 54. The immune cell of any one of Embodiments 48 to 53, further comprising a T2A self-cleaving peptide, wherein the T2A self-cleaving peptide comprises SEQ ID NO: 178, or a sequence sharing at least 75%, at least 80%, at least 85%, at least 90%, at least 95%, or at least 98% identity thereto.

Embodiment 55. The immune cell of any one of Embodiments 48 to 54, further comprising an interfering RNA, wherein the interfering RNA comprises SEQ ID NO: 179, or a sequence sharing at least 75%, at least 80%, at least 85%, at least 90%, at least 95%, or at least 98% identity thereto.

Embodiment 56. The immune cell of any one of Embodiments 1-55, wherein the immune cell is autologous.

Embodiment 57. The immune cell of any one of Embodiments 1-55, wherein the immune cell is allogeneic.

Embodiment 58. A pharmaceutical composition, comprising a therapeutically effective amount of the immune cells of any one of Embodiments 1-57.

Embodiment 59. The pharmaceutical composition of Embodiment 58, wherein the immune cell expresses both the first receptor and the second receptor.

Embodiment 60. The pharmaceutical composition of Embodiment 59, wherein at least about 50%, about 55%, about 60%, about 65%, about 70%, about 75%, about 80%, about 85%, about 90%, or about 95% of the immune cells express both the first receptor and the second receptor.

Embodiment 61. The pharmaceutical composition of Embodiment 59, wherein at least 90% of the immune cells express both the first receptor and the second receptor.

Embodiment 62. The pharmaceutical composition of any one of Embodiments 58-61, further comprising a pharmaceutically acceptable carrier, diluent or excipient.

Embodiment 63. The pharmaceutical composition of any one of Embodiments 58-62, for use as a medicament in the treatment of EGFR+ cancer.

Embodiment 64. A polynucleotide or polynucleotide system, comprising one or more polynucleotides comprising polynucleotide sequences encoding:
a.) a first receptor, comprising an extracellular ligand binding domain specific to Endothelial Growth Factor Receptor (EGFR); and
b.) a second receptor, comprising an extracellular ligand binding domain specific to a non-target antigen that has been lost in the EGFR+ cancer cell due to loss of heterozygosity,
wherein the first receptor is an activator receptor responsive to EGFR on the EGFR+ cancer cell; and wherein the second receptor is an inhibitory receptor responsive to the non-target antigen.

Embodiment 65. A polynucleotide or polynucleotide system, comprising one or more polynucleotides comprising polynucleotide sequences encoding the first receptor and the second receptor for use in generating the immune cells of any one of Embodiments 1-57.

Embodiment 66. A vector, comprising the one or more polynucleotides of Embodiment 64 or 65.

Embodiment 67. A method of killing EGFR+ cancer cell having loss of heterozygosity at an MHC class I locus, comprising administering to a subject an effective amount of the immune cell of any one of Embodiments 1-57 or the pharmaceutical composition of any one of Embodiments 58-62.

Embodiment 68. The method of Embodiment 67, wherein the EGFR+ cancer cell is a a lung cancer cell, a small cell lung cancer cell, a non-small cell lung cancer cell, a pancreatic ductal carcinoma cell, a colorectal cancer cell, a head and neck cancer cell, a esophagus and gastric adenocarcinoma cell, an ovarian cancer cell, a glioblastoma multiforme cell, a cervical squamous cell carcinoma cell, a kidney cancer cell, a papillary kidney cancer cell, a kidney renal clear cell carcinoma cell, a bladder cancer cell, a breast cancer cell, a bile duct cancer cell, a liver cancer cell, a prostate cancer cell, a sarcoma cell, a thyroid cancer cell, a thymus cancer cell, a stomach cancer cell, or a uterine cancer cell.

Embodiment 69. The method of Embodiment 67, wherein the EGFR+ cancer cell is a lung cancer cell.

Embodiment 70. The method of Embodiment 67, wherein the EGFR+ cancer cell is an EGFR+/HLA-A*02− cancer cell that does not express HLA-A*02; or a cancer cell derived from an HLA-A*02+ individual which does not express HLA-A*02.

Embodiment 71. The method of Embodiment 70, wherein the EGFR+/HLA-A*02-cancer cell is derived from an EGFR+/HLA-A*02+ cell by loss of heterozygosity at HLA-A leading to loss of HLA-A*02.

Embodiment 72. A method of treating EGFR+ cancer in a subject having an EGFR+ tumor having loss of heterozygosity at a locus encoding a non-target antigen, comprising administering to the subject an effective amount of the immune cell of any one of Embodiments 1-57 or the pharmaceutical composition of any one of Embodiments 58-62.

Embodiment 73. The method of Embodiment 72, wherein the subject is a heterozygous HLA-A*02 patient with a malignancy that expresses EGFR and has lost HLA-A*02 expression.

Embodiment 74. The method of Embodiment 72, wherein the subject is a heterozygous HLA-A*02 patient with recurrent unresectable or metastatic solid tumors that express EGFR and have lost HLA-A*02 expression.

Embodiment 75. A method of treating a cancer in a subject comprising:
a.) determining the genotype or expression level of a non-target antigen in non-malignant cells and cancer cells of the subject;
b.) determining the expression level of EGFR in cancer cells of the subject; and
c.) administering to the subject an effective amount of the immune cell of any one of Embodiments 1-57 or the pharmaceutical composition of any one of Embodiments 58-62 if the non-malignant cells express the non-target antigen and the cancer cells do not express the non-target antigen, and the cancer cells are EGFR positive.

Embodiment 76. The method of any one of Embodiments 67-75, wherein administration of the immune cell of any one of Embodiments 1-57 or the pharmaceutical composition of any one of Embodiments 58-62 reduces the size of a tumor in the subject.

Embodiment 77. The method of Embodiment 76, wherein the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%.

Embodiment 78. The method of Embodiment 76, wherein the tumor is eliminated.

Embodiment 79. The method of any one of Embodiments 67-75, wherein administration of the immune cell or the pharmaceutical composition arrests the growth of a tumor in the subject.

Embodiment 80. The method of any one of Embodiments 67-75, wherein administration of the immune cell of any one of Embodiments 1-57 or the pharmaceutical composition of any one of Embodiments 58-62 reduces the number of tumors in the subject.

Embodiment 81. The method of any one of Embodiments 67-80, wherein administration of the immune cell or the pharmaceutical composition results in selective killing of a cancer cell but not a normal cell in the subject.

Embodiment 82. The method of Embodiment 81, wherein at least about 60% of the cells killed are cancer cells, at least about 65% of the cells killed are cancer cells, at least about 70% of the cells killed are cancer cells, at least about 75% of the cells killed are cancer cells, at least about 80% of the cells killed are cancer cells, at least about 85% of the cells killed are cancer cells, at least about 90% of the cells killed are cancer cells, at least about 95% of the cells killed are cancer cells, or about 100% of the cells killed are cancer cells.

Embodiment 83. The method of Embodiment 81, wherein administration of the immune cell or pharmaceutical composition results in the killing of about 40%, about 50%, about 60%, about 70%, about 80%, about 90% or all of the cancer cells of the subject.

Embodiment 84. The method of any one of Embodiments 67-83, wherein administration of the immune cell or the pharmaceutical composition results in fewer side effects for the subject than administration of an otherwise equivalent immune cell comprising the first activator receptor but no second inhibitory receptor.

Embodiment 85. A method of making a plurality of immune cells, comprising:
a.) providing a plurality of immune cells, and
b.) transforming the plurality of immune cells with the polynucleotide system of Embodiment 64 or Embodiment 65, or the vector of Embodiment 66.

Embodiment 86. A kit comprising the immune cell of any one of Embodiments 1-57 or the pharmaceutical composition of any one of Embodiments 58-62.

Embodiment 87. The kit of Embodiment 86, further comprising instructions for use.

Embodiment 88. An immune cell responsive to loss of heterozygosity in a cancer cell, comprising:
a. a first receptor, optionally a chimeric antigen receptor (CAR) or T cell receptor (TCR), comprising an extracellular ligand binding domain specific to a target antigen selected from:
i. a cancer cell-specific antigen, or a peptide antigen thereof in a complex with a major histocompatibility complex class I (MHC-I); or
ii. epidermal growth factor receptor (EGFR), or a peptide antigen thereof in a complex with a major histocompatibility complex class I (MHC-I); and
b. a second receptor, optionally an inhibitory receptor, comprising an extracellular ligand binding domain specific to a non-target antigen that has been lost in the cancer cell due to loss of heterozygosity.

Embodiment 89. The method of Embodiment 88, wherein the non-target antigen comprises a polymorphism.

Embodiment 90. The immune cell of Embodiment 89, wherein the non-target antigen comprises a COLEC12 antigen that shares at least 95% identity to SEQ ID NO: 87 and the polymorphism comprises an S or P at position 522 of SEQ ID NO: 87.

Embodiment 91. The immune cell of Embodiment 89, wherein the non-target antigen comprises a APCDD1 antigen that shares at least 95% identity to SEQ ID NO: 88, SEQ ID NO: 134 or SEQ ID NO: 135, and the polymorphism is selected from the group consisting of:
a. A V, I or L at position 150 of SEQ ID NO: 88;
b. a Y or S at position 165 of SEQ ID NO: 134; and
c. A Q or R at position 28 of SEQ ID NO: 135.

Embodiment 92. The immune cell of Embodiment 89, wherein the non-target antigen comprises a CXCL16 antigen that shares at least 95% identity to SEQ ID NO: 86 and the polymorphism is selected from the group consisting of:
a. an I or T at position 142 of SEQ ID NO: 86; and
b. an A or V at position 200 of SEQ ID NO: 86.

Embodiment 93. The immune cell of Embodiment 88 or 89, wherein the non-target antigen comprises HLA-A*02.

Embodiment 94. The immune cell of any one of Embodiments 88-93, wherein the target antigen is expressed by the cancer cell.

Embodiment 95. The immune cell of any one of Embodiments 88-94, wherein the non-target antigen is not expressed by the cancer cell.

Embodiment 96. The immune cell of any one of Embodiments 88-95, wherein the non-target antigen is expressed by a non-target cell.

Embodiment 97. The immune cell of any one of Embodiments 88-96, wherein the non-target cell expresses both target antigen and the non-target antigen.
Embodiment 98. The immune cell of any one of Embodiments 88-97, wherein the target antigen is a cancer cell-specific antigen.
Embodiment 99. The immune cell of any one of Embodiments 88-98, wherein the target antigen is a peptide antigen of a cancer cell-specific antigen in a complex with a major histocompatibility complex class I (MHC-I).
Embodiment 100. The immune cell of any one of Embodiments 88-99, wherein the cancer cell is a lung cancer cell, a glioblastoma cell, a breast cancer cell, a head and neck cancer cell or a colorectal cancer cell.
Embodiment 101. The immune cell of any one of Embodiments 88-100, wherein the cancer cell expresses EGFR.
Embodiment 102. The immune cell of any one of Embodiments 88-101, wherein the first receptor and the second receptor together specifically activate the immune cell in the presence of the cancer cell.
Embodiment 103. The immune cell of Embodiment 102, wherein the immune cell is a T cell, macrophage, NK cell, iNKT cell, or a gamma delta T cell.
Embodiment 104. The immune cell of Embodiment 103, wherein the T cell is a CD8+CD4− T cell.
Embodiment 105. The immune cell of any one of Embodiments 88-104, wherein the EGFR comprises a sequence that shares at least 95% identity to any one of SEQ ID NOs: 1-8.
Embodiment 106. The immune cell of any one of Embodiments 88-105, wherein the first receptor is a T cell receptor (TCR).
Embodiment 107. The immune cell of any one of Embodiments 88-106, wherein the first receptor is a chimeric antigen receptor (CAR).
Embodiment 108. The immune cell of Embodiment 106 or 107, wherein the extracellular ligand binding domain of the first receptor comprises an antibody fragment, a single chain Fv antibody fragment (scFv), a β chain variable domain (Vβ), or a TCR α chain variable domain and a TCR R chain variable domain.
Embodiment 109. The immune cell of Embodiment 106 or 107, wherein the extracellular ligand binding domain of the first receptor comprises an scFv.
Embodiment 110. The immune cell of Embodiment 109, wherein the scFv comprises a sequence selected from the group consisting of SEQ ID NOs: 9-18, or a sequence having at least 85%, at least 90%, at least 95%, at least 97% or at least 99% identity thereto.
Embodiment 111. The immune cell of Embodiment 109, wherein the scFv comprises or consists essentially of a sequence selected from the group consisting of SEQ ID NOs: 9-18.
Embodiment 112. The immune cell of Embodiment 106 or 107, wherein the extracellular ligand binding domain of the first receptor comprises VH and VL domain.
Embodiment 113. The immune cell of Embodiment 112, wherein the VH domain comprises a sequence selected from the group consisting of SEQ ID NOs: 19-24, or a VH sequence disclosed in Table 2, or a sequence having at least 85%, at least 90%, at least 95%, at least 97% or at least 99% identity thereto.
Embodiment 114. The immune cell of Embodiment 112, wherein the VH domain comprises or consists essentially of a sequence selected from the group consisting of SEQ ID NOs: 19-24, or a VH sequence disclosed in Table 2.
Embodiment 115. The immune cell of any one of Embodiments 112-114, wherein the VL domain comprises a sequence selected from the group consisting of SEQ ID NOs: 25-30, or a VH sequence disclosed in Table 2, or a sequence having at least 85%, at least 90%, at least 95%, at least 97% or at least 99% identity thereto.
Embodiment 116. The cell of any one of Embodiments 112-114, wherein the VL domain comprises or consists essentially of a sequence selected from the group consisting of SEQ ID NOs: 25-30, or a VL sequence disclosed in Table 2.
Embodiment 117. The immune cell of any one of Embodiments 105-107, wherein the extracellular ligand binding domain of the first receptor comprises complementarity-determining regions (CDRs) selected from the group consisting of SEQ ID NOs: 31-65, or a CDR sequence disclosed in Table 3.
Embodiment 118. The immune cell of any one of Embodiments 88-117, wherein the extracellular ligand binding domain of the second receptor comprises an antibody fragment, a single chain Fv antibody fragment (scFv), a β chain variable domain (Vβ), or a TCR α chain variable domain and a TCR R chain variable domain.
Embodiment 119. The immune cell of any one of Embodiments 88 or 93-118, wherein the extracellular ligand binding domain of the second receptor comprises an scFv.
Embodiment 120. The immune cell of Embodiment 119, wherein the scFv comprises a sequence having at least 85%, at least 90%, at least 95%, at least 97% or at least 99% identity to any one of SEQ ID NOs: 89-100.
Embodiment 121. The immune cell of Embodiment 119, wherein the scFv comprises or consists essentially of a sequence of any one of SEQ ID NOs: 89-100.
Embodiment 122. The immune cell of any one of Embodiments 88 or 93-118, wherein the extracellular ligand binding domain of the second receptor comprises CDRs selected from the group consisting of SEQ ID NOs: 101-112.
Embodiment 123. The immune cell of any one of Embodiments 88-122, wherein the second receptor comprises a LILRB1 intracellular domain or a functional variant thereof.
Embodiment 124. The immune cell of Embodiment 123, wherein the LILRB1 intracellular domain comprises a sequence at least 95% identical to SEQ ID NO: 124.
Embodiment 125. The immune cell of any one of Embodiments 88-124, wherein the second receptor comprises a LILRB1 transmembrane domain or a functional variant thereof.
Embodiment 126. The immune cell of Embodiment 125, wherein the LILRB1 transmembrane domain or a functional variant thereof comprises a sequence at least 95% identical to SEQ ID NO: 133.
Embodiment 127. The immune cell of any one of Embodiments 88-126, wherein the second receptor comprises a LILRB1 hinge domain or functional fragment or variant thereof.
Embodiment 128. The immune cell of Embodiment 127, wherein the LILRB1 hinge domain comprises a sequence at least 95% identical to SEQ ID NO: 132, SEQ ID NO: 125 or SEQ ID NO: 126.
Embodiment 129. The immune cell of any one of Embodiments 88-128, wherein the second receptor comprises a LILRB1 intracellular domain and a LILRB1 transmembrane domain, or a functional variant thereof.
Embodiment 130. The immune cell of Embodiment 129, wherein the LILRB1 intracellular domain and LILRB1 transmembrane domain comprises SEQ ID NO: 128 or a sequence at least 95% identical to SEQ ID NO: 128.

Embodiment 131. The immune cell of any one of Embodiments 88-130, wherein the immune cell is a T cell, macrophage, NK cell, iNKT cell, or a gamma delta T cell.
Embodiment 132. The immune cell of Embodiment 131, wherein the T cell is a CD8+CD4− T cell.
Embodiment 133. A pharmaceutical composition, comprising a therapeutically effective amount of the immune cells of any one of Embodiments 88-132.
Embodiment 134. The pharmaceutical composition of Embodiment 133, further comprising a pharmaceutically acceptable carrier, diluent or excipient.
Embodiment 135. The pharmaceutical composition of Embodiment 133 or 134, for use as a medicament in the treatment of cancer.
Embodiment 136. A polynucleotide system, comprising one or more polynucleotides comprising polynucleotide sequences encoding:
 a. a first receptor, optionally a chimeric antigen receptor (CAR) or T cell receptor (TCR), comprising an extracellular ligand binding domain specific to a target antigen selected from:
  i. a cancer cell-specific antigen, or a peptide antigen thereof in a complex with a major histocompatibility complex class I (MHC-I); or
  ii. epidermal growth factor receptor (EGFR), or a peptide antigen thereof in a complex with a major histocompatibility complex class I (MHC-I); and
 b. a second receptor, optionally an inhibitory receptor, comprising an extracellular ligand binding domain specific to a non-target antigen that has been lost in the cancer cell due to loss of heterozygosity.
Embodiment 137. The polynucleotide system of Embodiment 136, wherein the non-target antigen comprises a polymorphism.
Embodiment 138. The polynucleotide system of Embodiment 137, wherein the non-target antigen is an COLEC12 antigen that shares at least 95% identity to SEQ ID NO: 87 and the polymorphism comprises an S or P at position 522 of SEQ ID NO: 87.
Embodiment 139. The polynucleotide system of Embodiment 137, wherein the non-target antigen is a APCDD1 antigen that shares at least 95% identity to SEQ ID NO: 88, SEQ ID NO: 134 or SEQ ID NO: 135, and the polymorphism is selected from the group consisting of:
 a. A V, I or L at position 150 of SEQ ID NO: 88;
 b. a Y or S at position 165 of SEQ ID NO: 134; and
 c. A Q or R at position 28 of SEQ ID NO: 135.
Embodiment 140. The polynucleotide system of Embodiment 137, wherein the non-target antigen is a CXCL16 antigen that shares at least 95% identity to SEQ ID NO: 86 and the polymorphism is selected from the group consisting of:
 a. an I or T at position 142 of SEQ ID NO: 86; and
 b. an A or V at position 200 of SEQ ID NO: 86.
Embodiment 141. The polynucleotide system of Embodiment 136 or 137, wherein the non-target antigen is HLA-A*02.
Embodiment 142. A vector, comprising the one or more polynucleotides of any one of Embodiments 136-141.
Embodiment 143. A method of killing a plurality of cancer cell and/or treating cancer in a subject, comprising administering to the subject an effective amount of the immune cell of any one of Embodiments 88-132 or the pharmaceutical composition of any one of Embodiments 46-48.
Embodiment 144. The method of Embodiment 143, wherein a plurality of cancer cells express the target antigen.
Embodiment 145. The method of Embodiment 143 or 144, wherein a plurality of cancer cells do not express the non-target antigen.
Embodiment 146. A method of making a plurality of immune cells, comprising:
 a. providing a plurality of immune cells, and
 b. transforming the plurality of immune cells with the polynucleotide system of any one of Embodiments 136-141, or the vector of Embodiment 142.
Embodiment 147. A kit comprising the immune cell of any one of Embodiments 88-132 or the pharmaceutical composition of any one of Embodiments 133-135.
Embodiment 148. The kit of Embodiment 147, further comprising instructions for use.

EXAMPLES

The following Examples are intended for illustration only and do not limit the scope of the disclosure. Throughout the examples, the term "blocker antigen" is used to describe embodiments of a non-target antigen.

Figure 18:
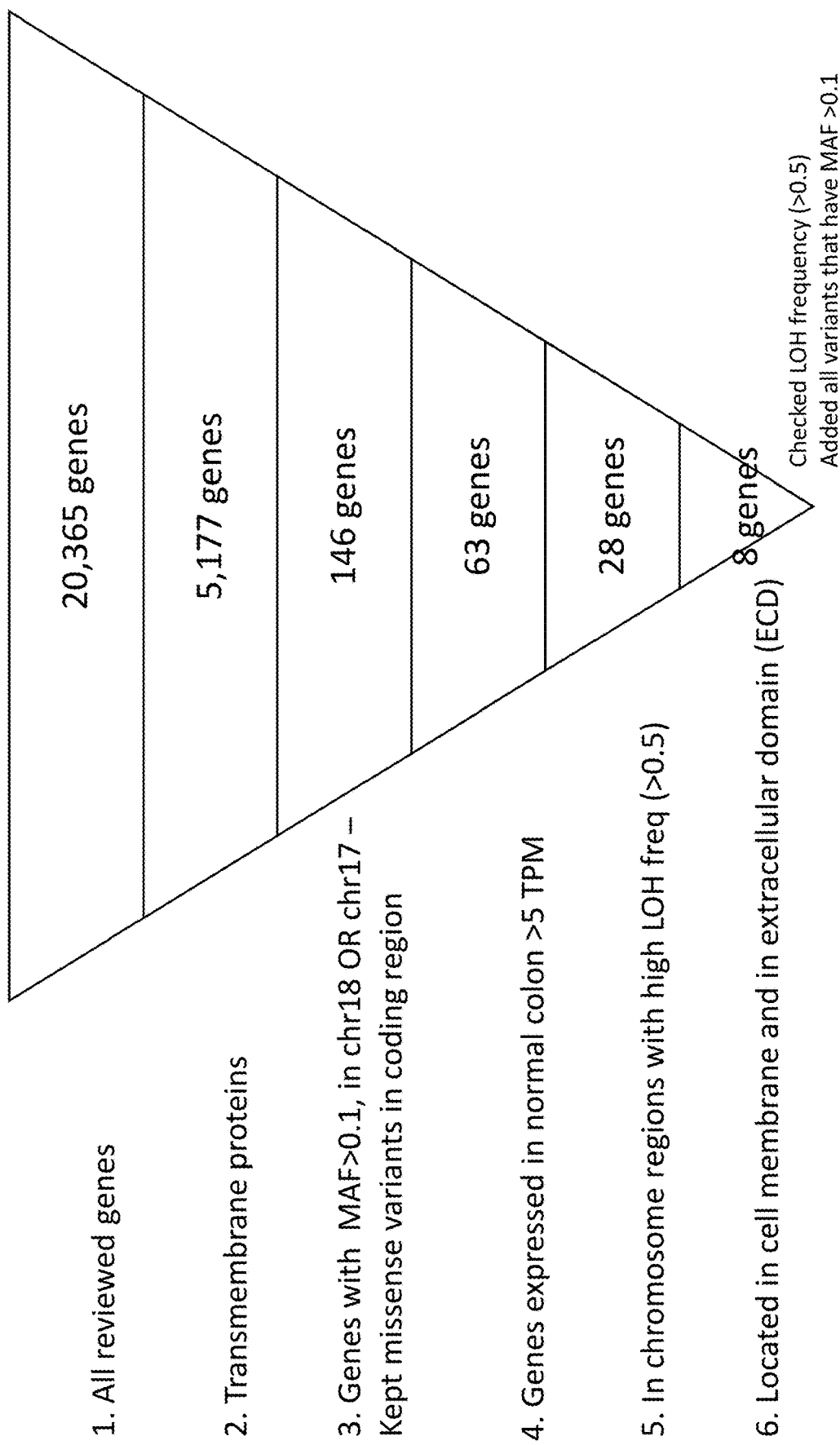
FIG. 18 is a diagram showing the bioinformatics search process used to identify potential non-target antigen candidate genes.

Example 1: Identification of Blocker Targets Lost in Cancer Cells Due to Loss of Heterozygosity A bioinformatics pipeline was used to identify candidate blocker targets. The set of human genes was searched for genes with common nonsynonymous variants in extracellular domains that have high loss of heterozygosity (greater than 0.5) in colorectal cancers. Genes with nonsynonymous variants were searched in dbSNP, a database of single nucleotide polymorphisms, that also includes small-scale insertions and deletions along with publication, population frequency, molecular consequence, and genomic mapping information. Common variations were defined as having a minor allele frequency (MAF) of greater than or equal to 0.01 in at least one major population and with at least two unrelated individuals having the minor allele in NCBI. MAF of greater than or equal to 0.1 as criterion for common variations. The focus was on chromosomes 17 and 18, as these chromosomes have high LOH in colorectal cancers. Genes were filtered for membrane proteins, colon expression, and common nonsynonymous variants in the extracellular domain, as described above. A summary of the search process is shown in FIG. 18.

Additional databases used in this analysis include the following: Uniprot (The Universal Protein Resource), which was used resource for protein sequence and annotation data hosted by EMBL-EBI, SIB and PIR. GTEx (The Genotype-Tissue Expression) was use as a public resource for tissue-specific gene expression and regulation. It contains samples from 54 non-diseased tissue sites across nearly 1000 individuals. TCGA (The Cancer Genome Atlas) was used as a resource for over 20,000 primary cancer and matched normal samples spanning 33 cancer types. The TCGA-COADREAD dataset is a Colon Adenocarcinoma and Rectum Adenocarcinoma dataset. CCLE (Cancer cell line Encyclopedia) contains information on 57 Colorectal Cancer (CRC) cell lines.

RNASeqDB is database of processed data from the GTEx and TCGA using the same pipeline which allows comparative studies from Memorial Sloan Kettering Cancer Center. 372 TCGA-COADREAD samples and 339 normal colon samples from GTEx were analyzed.

COLEC12, CXCL16 and APCDD1 were identified as potential blocker targets. Table 14 summarizes the expression data for these genes in colorectal cancers. Expression data from UCSC Xena browser (for TCGA) and CCLE samples.

TABLE 14

| | Expression | | | |
|---|---|---|---|---|
| Gene name | TCGA-Colorectal Adenocarcenoma (Median-FPKM (383 samples) | Median expression_CCLE_colorectal_RPKM (57 cell lines) | Colon-Sigmoid | Colon-Transverse |
| CXCL16 | 5.7509 | 25.88884 | 11.51 | 15.44 |
| COLEC12 | −0.6416 | 0.01964 | 27.25 | 11.24 |
| APCDD1 | 4.1498 | 0.58982 | 12.26 | 11.22 |

Table 15 summarizes the variants and minor allele frequencies.

TABLE 15

| | Position, Characteristics and Variation | | | | |
|---|---|---|---|---|---|
| Gene names | All variants | TCGA-Colorectal Adenocarcenoma_ Frequency of heterozygous deletion (score = −1) | Protein position of Amino Acid Change | Amino acid Change | MAF |
| CXCL16 | rs2277680, rs1050998 | 0.569805195 | 1. 200, 2. 142 | 1. A/V, 2. I/T | 1. 0.4615, 2. 0.4633 |
| COLEC12 | rs2305025 | 0.584415584 | 522 | S/P | 0.6252 |
| APCDD1 | rs1786683 | 0.600649351 | 165 | Y/S | 0.2496 |

TABLE 16

| | LOH Frequencies in Various Cancers | | |
|---|---|---|---|
| | COLEC12 | LOH Freq CXCL16 | APCDD1 |
| All cancers | 0.23 | 0.36 | 0.23 |
| CRC | 0.59 | 0.58 | 0.6 |
| Lung | 0.3 | 0.58 | 0.29 |
| Pancreatic | 0.3 | 0.48 | 0.28 |
| Ovarian | 0.39 | 0.74 | 0.36 |
| DBCL | 0.15 | 0.23 | 0.13 |
| Blood | 0.06 | 0.11 | 0.05 |
| variant | S/P | I/T | Y/S |
| MAF | 0.63 | 0.46 | 0.25 |

Example 2: Identification of Blocker Ligand Binding Domains

Publically available antibodies to candidate blocker antigens are sequenced, if CDR sequences are unknown. If no antibodies to candidate blocker targets are available, these antibodies are generated by immunization of mice, rats, or rabbits with purified protein (e.g., COLEC12, CXCL16 and other targets described in the Examples). Sera from immunized animals is used to screen for mAbs for binding to blocker targets. Antibodies to blocker targets are also generated using the huTARG system. Antibodies with the desired specificity are then isolated and sequenced to determine CDR sequences.

CDR sequence from antibodies to blocker targets are used to generate scFv using standard molecular biology techniques. Candidate scFv are fused to inhibitory receptor hinge or transmembrane domains to generate inhibitory receptors using standard molecular biology techniques. Candidate scFv are also fused to activator receptor hinge or transmembrane domains (e.g., CAR) to generate full length activator receptors to use as a positive control for scFv binding to target antigens. The ability of candidate scFv to work in the context of an inhibitory receptor is assayed in Jurkat cells using the NFAT-luciferase reporter assay.

Example 3: Methods for Jurkat and Primary T Cell Activation Experiments

Cell Culture

Jurkat cells encoding an NFAT Luciferase reporter were obtained from BPS Bioscience. In culture, Jurkat cells were maintained in RPMI media supplemented with 10% FBS, 1% Pen/Strep and 0.4 mg/mL G418/Geneticin. All other cell lines used in this study were obtained from ATCC, and maintained as suggested by ATCC.

Jurkat Cell Transfection

Jurkat cells were transiently transfected via 100 uL format Neon electroporation system (Lonza) according to manufacturer's protocol using the following settings: 3 pulses, 1500V, 10 msec. Cotransfection was performed with 1-3 ug of activator CAR or TCR construct and 1-3 ug of blocker constructs or empty vector per 1e6 cells and recovered in RPMI media supplemented with 20% heat-inactivated FBS and 0.1% Pen/Strep.

Jurkat-NFAT-Luciferase Activation Studies

Jurkat cells were resuspended in 15 uL of RPMI supplemented with 10% heat-inactivated FBS and 0.1% Pen/Strep, added to the peptide-loaded beads and co-cultured for 6 hours. ONE-Step Luciferase Assay System (BPS Bioscience) was used to evaluate Jurkat luminescence. Assays were performed in technical duplicates.

Primary T Cell Transduction, Expansion, and Enrichment

Frozen PBMCs were thawed in 37° C. water bath and cultured at 1e6 cells/mL in LymphoONE (Takara) with 1% human serum and activated using 1:100 of T cell TransAct (Miltenyi) supplemented with 300 IU/ml IL-2. After 24 hours, lentivirus was added to PBMCs at a MOI of 5. PBMCs were cultured for 2-3 additional days to allow cells to expand under TransAct stimulation. Post expansion, activator and blocker transduced primary T cells were enriched using anti-PE microbeads (Miltenyi) according to manufacturer's instructions. Briefly, primary T cells were incubated with EGFR-Fc (R&D Systems) at 1:25 dilution for 30 minutes at roomt temperature in MACS buffer (0.5% BSA+2 mM EDTA in PBS). Cells were washed 3 times in MACS buffer and incubated in secondary antibody (1:1200) for 30 minutes at room temperature in MACS buffer. Cells were then incubated in anti-PE microbeads and passed through the LS column (Miltenyi).

Primary T Cell In Vitro Cytotoxicity Studies

For cytotoxicity studies with pMHC targets, enriched primary T cells were incubated with HeLa or HCT116 target cells that express GFP or RFP. For "tumor" cells, WT HeLa or HLA-A*02 knocked-out HCT116 were used and for "normal" cells, HLA-A*02 transduced HeLa or WT HCT116 were used. The cocultures were imaged using an IncuCyte live cell imager and target cell fluorescence area was used to quantify live target cells.

Example 4: HLA-A*02 Inhibitory Receptor Blocks EGFR-Mediated Activation of Jurkat Cells The ability of a inhibitory receptor with an HLA-A-A*02 antigen binding domain and a LIR-1 ICD (C1765 or C2162) to block activation of Jurkat cells expressing an activator CAR with an EGFR antigen binding domain (e.g. CT479, CT486, or CT489) was assayed using the NFAT-luciferase reporter system as previously described. Normal HeLa tumor cells, which were EGFR+ and HLA-A*02-, were used as target cells. EGFR+/HLA-A*02- HeLa cells were also transduced with a polynucleotide encoding HLA-A*02+ to generate EGFR+/HLA-A*02+ HeLa cells to use as target cells expressing both activator and blocker antigens.

As shown in FIG. 1A, expression of the HLA-A*02 LIR-1 blocker (C1765) in Jurkat cells expressing the EGFR CAR (CT479) shifts the CAR $E_{MAX}$ by >5 fold compared to the CAR Emax of Jurkat cells that do not express the blocker.

Figure 1B:
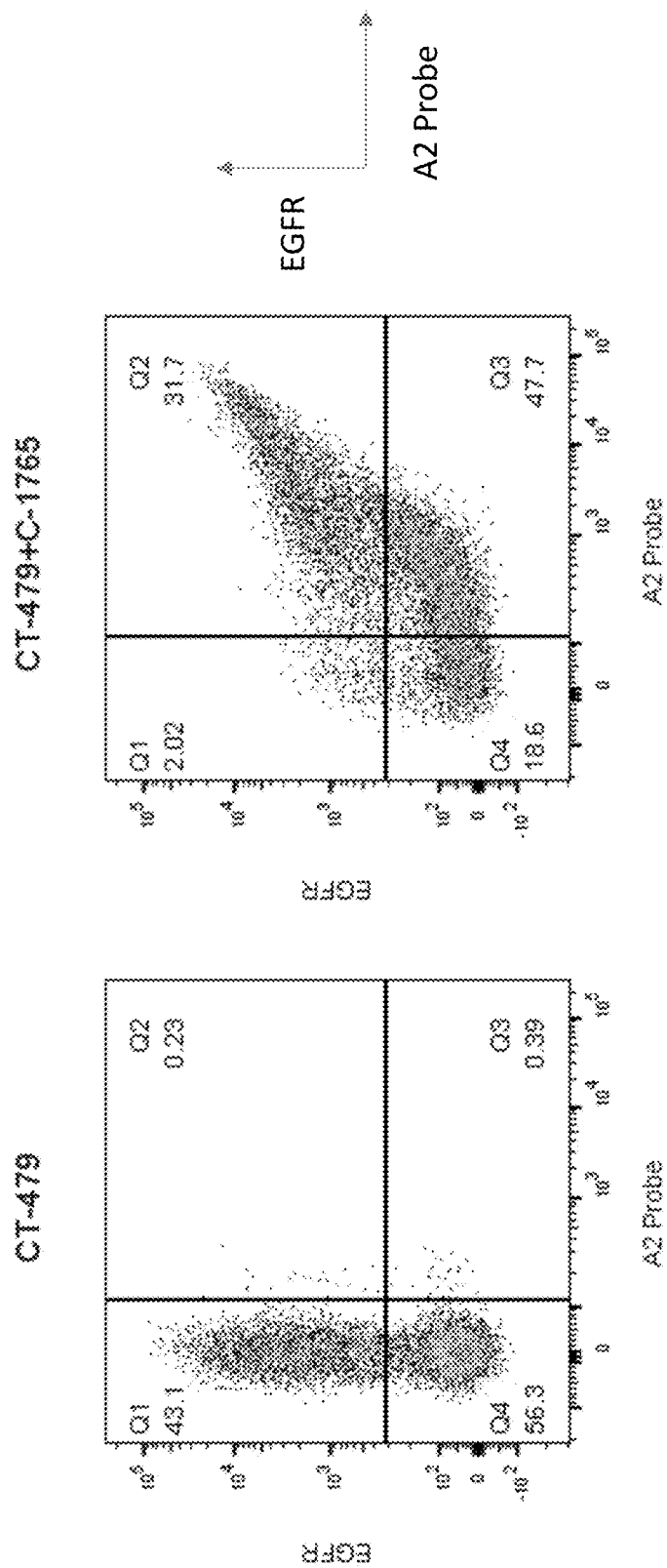
FIG. 1B is a pair of fluorescence activated cell sorting (FACS) plots showing expression of activator (CT479) and blocker (C1765) receptors on Jurkat cells.
Figure 1C:
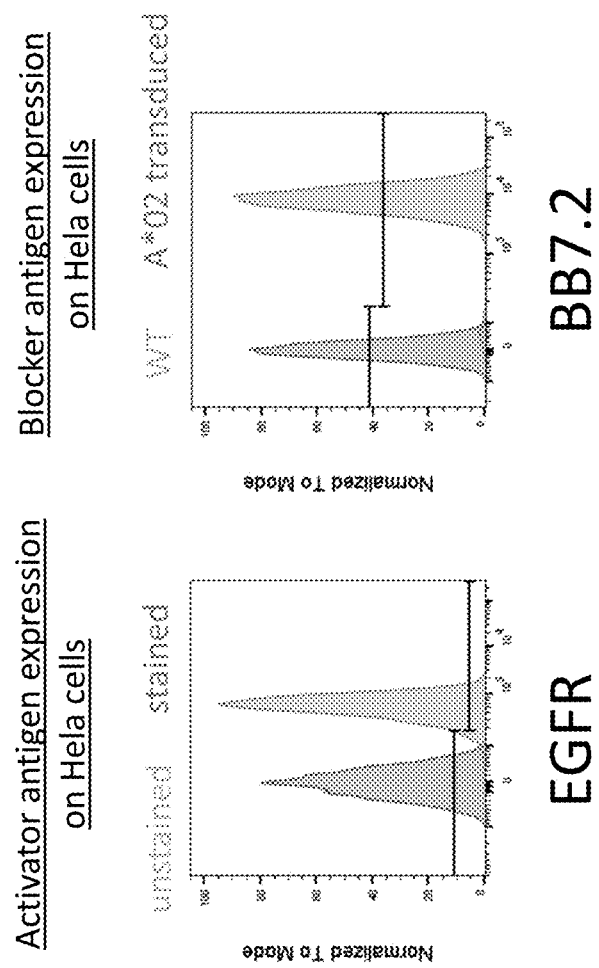
FIG. 1C is a pair of plots showing expression of activator antigen (EGFR) and blocker antigen (HLA-A*02) on HeLa cells. HLA-A*02 expression was detected using BB7.2 antibody.
Figure 2B:
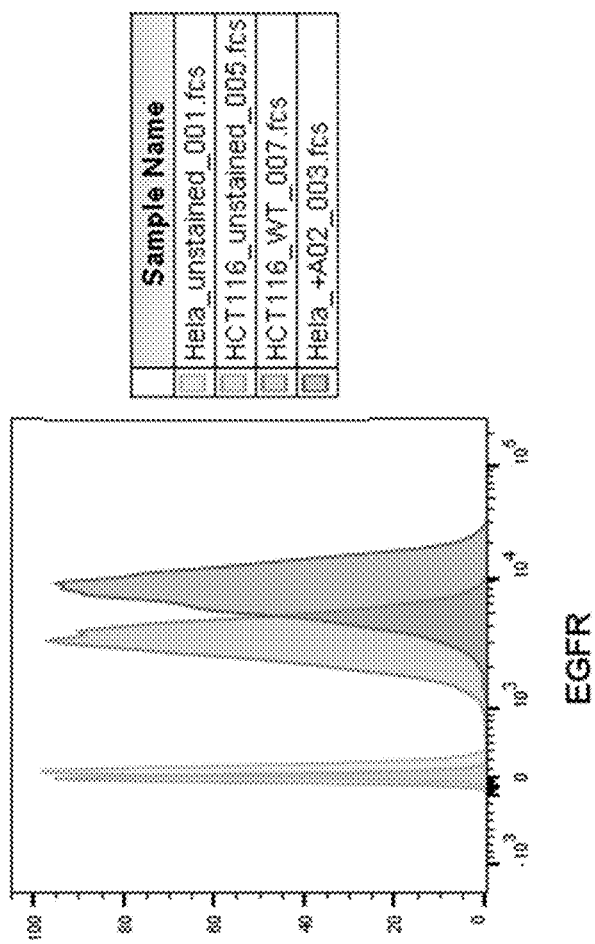
FIG. 2B shows expression of EGFR on HeLa cells and HCT116 cells. HeLa and HCT1116 cells were labeled with anti-EGFR antibody. Green: unlabeled HeLa; orange: unlabeled HCT1116; blue: wild type HCT116 labeled with anti-EGFR; red: HeLa cells transduced with HLA-A*02 and labeled with anti-EGFR.
Figure 2A:
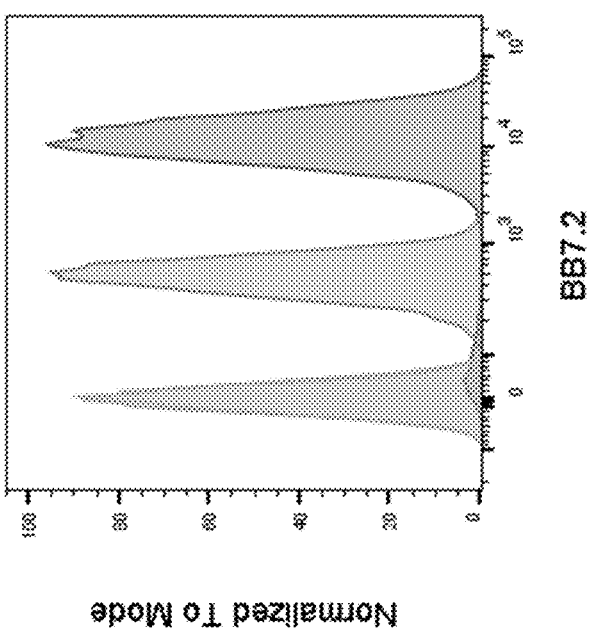
FIG. 2A shows the expression of HLA-A*02 on HeLa cells transduced with HLA-A*02, and HCT116 cells. HeLa and HCT1116 cells were labeled with the anti-HLA-A2 antibody BB7.2 and FACs sorted. Green: unlabeled HeLa; orange: unlabeled HCT116; blue: wild type HCT116 labeled with BB7.2; red: HeLa cells transduced with HLA-A*02 and labeled with BB7.2.
Figures 3C, 3D:
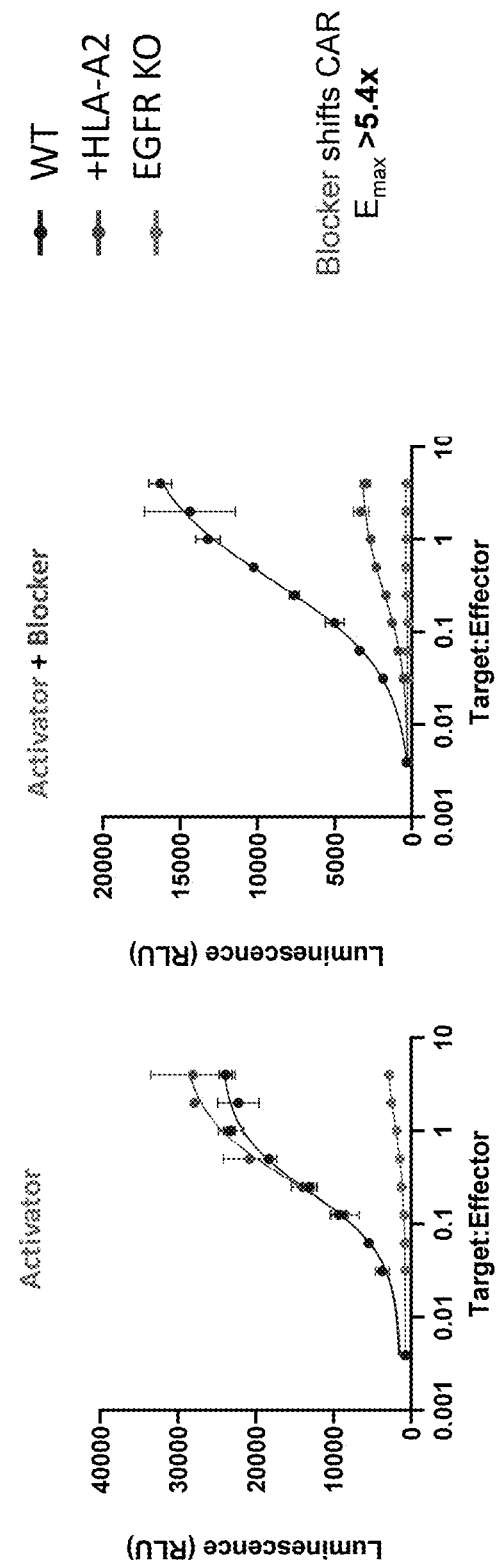
FIG. 3C shows EGFR CAR activation of Jurkat cells expressing an EGFR CAR, when co-cultured with HeLa target cells.
FIG. 3D shows that EGFR CAR activation of Jurkat cells can be blocked by an HLA-A*02 LIR-1 inhibitory receptor. Co-expression of the EGFR CAR and HLA-A*02 LIR-1 inhibitory receptor by Jurkat cells leads to a shift in the CAR $E_{MAX}$ of approximately 5.4x when Jurkat cells are presented with HeLa target cells expressing EGFR and HLA-A*02.
Figure 17A:
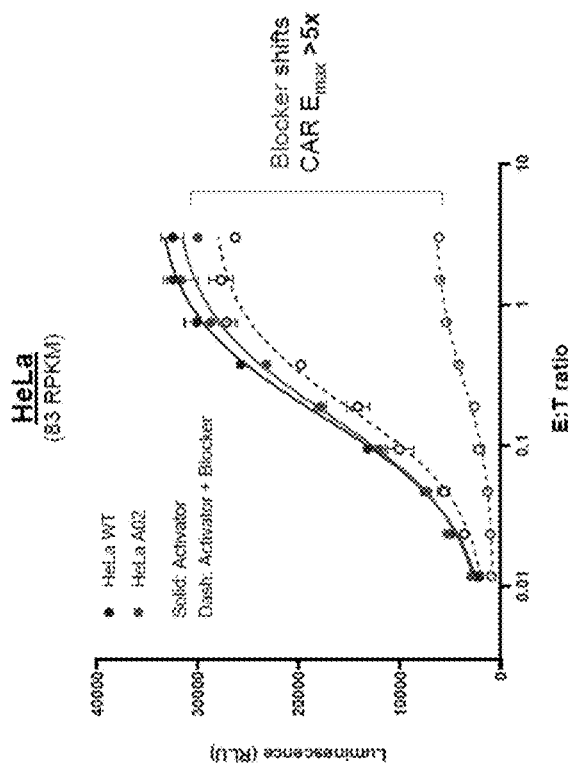
FIG. 17A shows that activation of Jurkat cells by an EGFR scFv CAR can be blocked by a pMHC HLA-A*02 scFv LIR-1 based inhibitory receptor using SiHa target cells expressing HLA-A*02 (SiHa A02), but not by SiHa cells that do not express HLA-A*02 (SiHa WT).
Figure 17B:
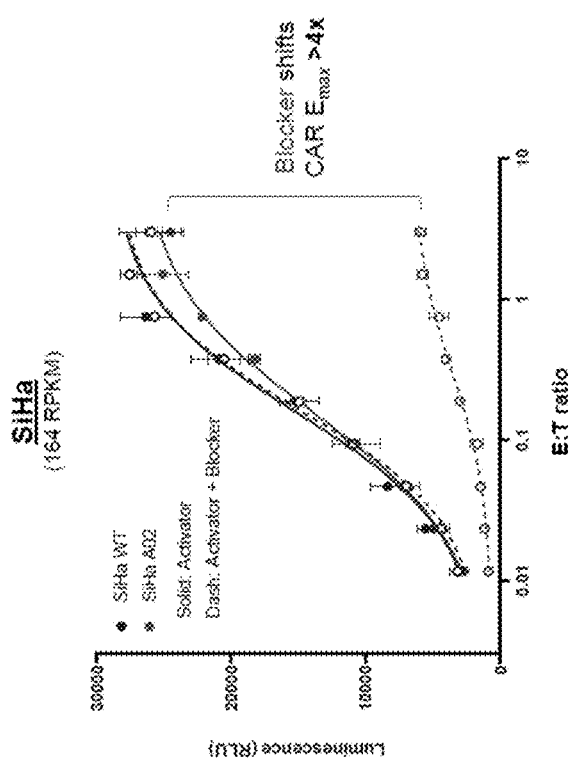
FIG. 17B shows that activation of Jurkat cells by an EGFR scFv CAR can be blocked by a pMHC HLA-A*02 scFv LIR-1 based inhibitory receptor using HeLa target cells expressing HLA-A*02 (HeLa A02), but not by HeLa cells that do not express HLA-A*02 (HeLa WT).

Furthermore, lower blocking was observed with lower HLA-A2 expression levels on target cells. Normal HCT116 cells are EGFR+ and HLA-A*02+. The levels of EGFR and HLA-A*02 were assayed in HCT116 cells and HeLa cells transduced with polynucleotides encoding the HLA-A*02 polynucleotides using an anti-EGFR antibody and an anti-HLA-A*02 antibody (BB7.2) followed by FACs sorting. As shown in FIGS. 2A & 2B, HCT116 cells have lower levels of blocker HLA-A*02 antigen than transduced HeLa cells. When Jurkat cells expressing the EGFR CAR and HLA-A*02 LIR-1 blocker was presented with HCT116 target cells expressing EGFR and HLA-A*02 antigens, presence of the HLA-A*02 LIR-1 blocker shifted the $E_{MAX}$ of the EGFR CAR 1.8 fold (FIG. 3B). In contrast, transduced HeLa cells, which expressed a higher level of HLA-A*02 antigen, were able to mediate an EGFR CAR $E_{MAX}$ shift of >5 fold (FIG. 1B, FIG. 17B, and FIG. 3D). As a control, there was minimal activation by EGFR knockout HCT116 cells (FIG. 3A).

Figure 4A:
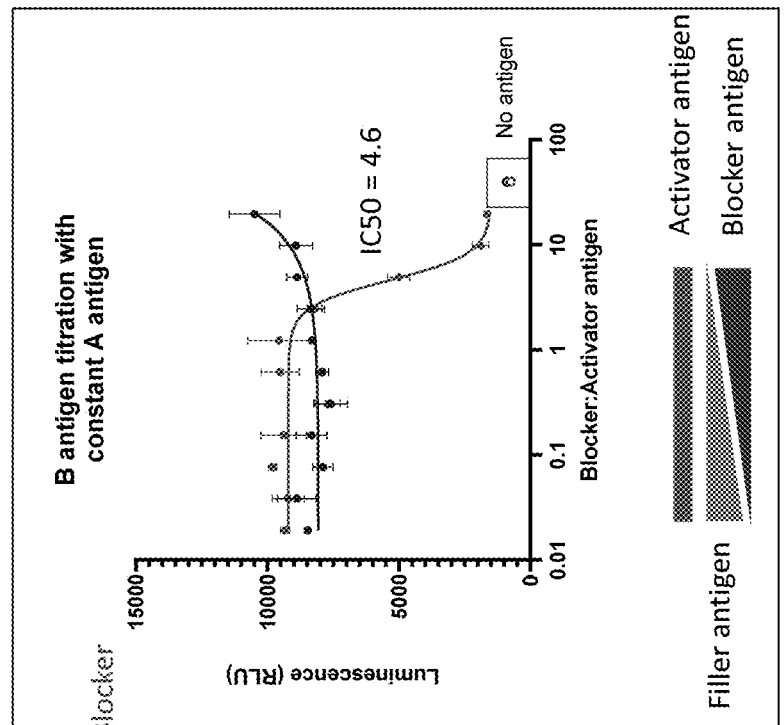
FIG. 4A shows titration of activator antigen in a bead-based assay to determine the optimal amount of activator antigen.
Figure 4B:
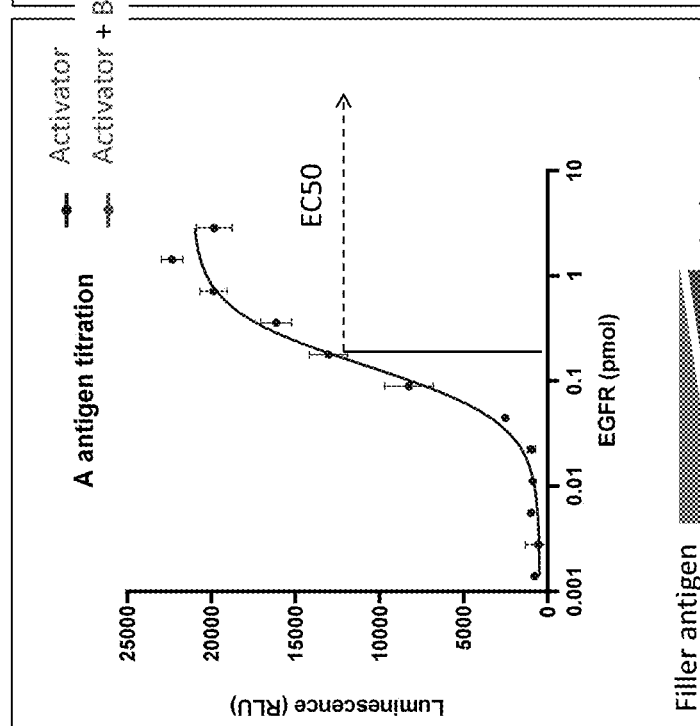
FIG. 4B shows titration of blocker antigen in a bead based assay to determine the optimal ratio of activator to blocker antigen.
Figure 5:
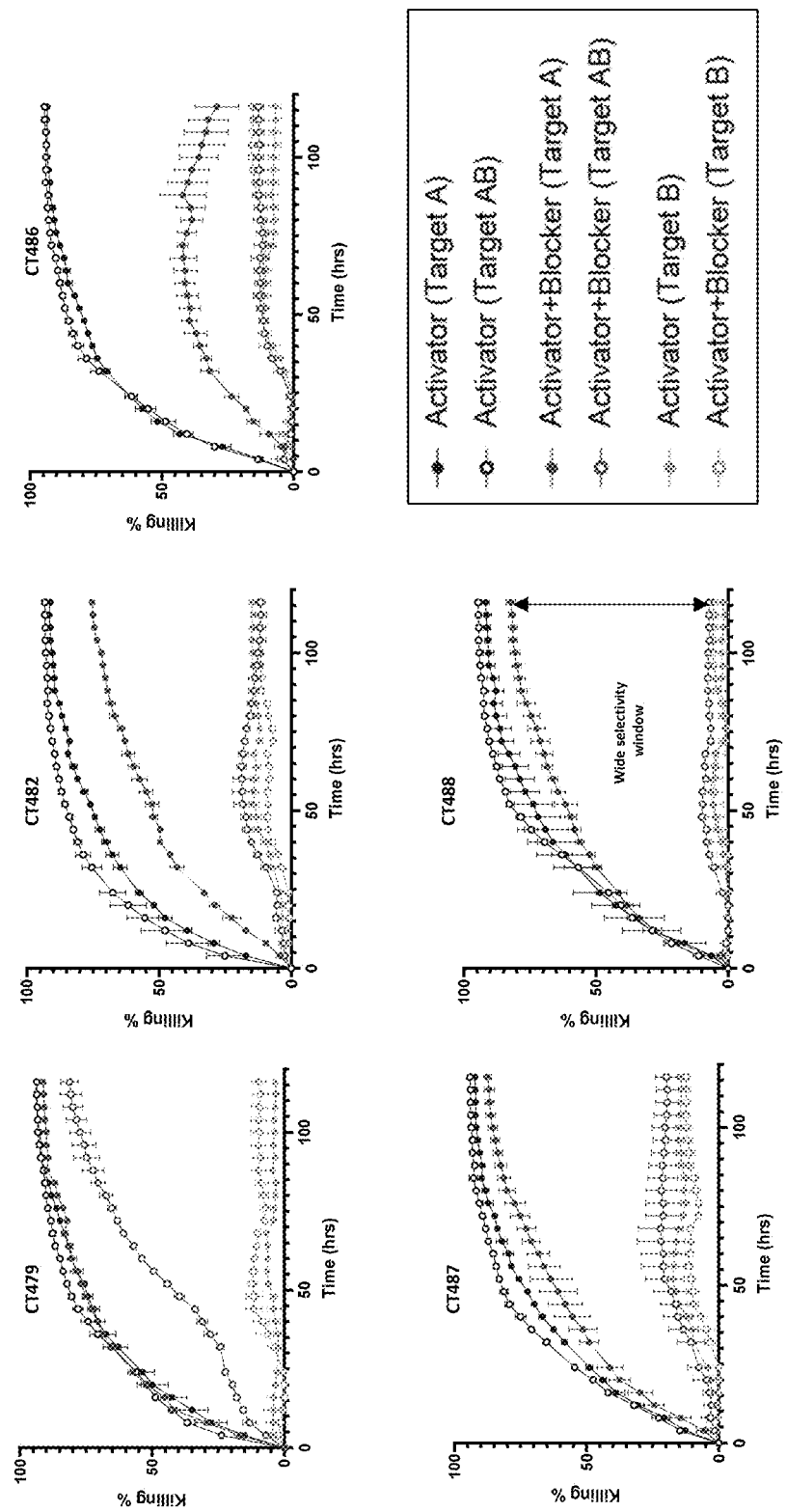
FIG. 5 is a series of plots and a table that show that a different degree of blocking is observed when an HLA-A*02 scFv LIR1 inhibitor is used with different EGFR scFv CAR activators in primary T cells.

The ratio of blocker to activator necessary to achieve 50% blocking using the EGFR CAR and HLA-A*02 LIR-1 blocker was assayed using a bead based system, which is shown in FIG. 4A and FIG. 4B.

To determine the EC50 of the activator antigen, activator beads were coated with activator antigen at different concentrations to determine EC50. An irrelevant protein was added to each concentration so that the total protein concentration was the same, and a constant amount of beads was added to Jurkat effector cells expressing the EGFR CAR (FIG. 4A).

To determine blocker antigen IC50, beads were coated with activator antigen at the EC50 concentration (determined in FIG. 4A), and coated with blocker antigen at different concentrations. An irrelevant protein was added at each concentration so that the total protein concentration remained the same, and a constant amount of beads was added to Jurkat effector cells expressing either the EGFR CAR or the EGFR CAR and the HLA-A*02 LIR-1 blocker (FIG. 4B).

Example 5: Characterization of Specific Receptor Pairs

T cells transfected with either an EGFR scFv CAR activator (CT-479, CT-482, CT-486, CT-487, CT-488, or CT-489, as indicated in FIGS. 5 and 7-9), or with EGFR scFv CAR activator and an HLA-A*02 PA2.1 scFv LIR1 inhibitor (C1765 or C2162) were co-cultured with HeLa target cells. Normal HeLa cell lines express EGFR but not HLA-A*02, were transduced to express the HLA-A*02 inhibitory receptor target. Cells were co-cultured at a 1:1 ratio of effector to target (E:T). In the lower right of FIG. 5, effector cell receptor expression is indicated first, while HeLa cell expression is in parentheses. As can be seen from FIG. 5, a different degree of blocking is observed when the same HLA-A*02 PA2.1 scFv LIR1 inhibitor was used with different EGFR activator receptors.

Figure 10:
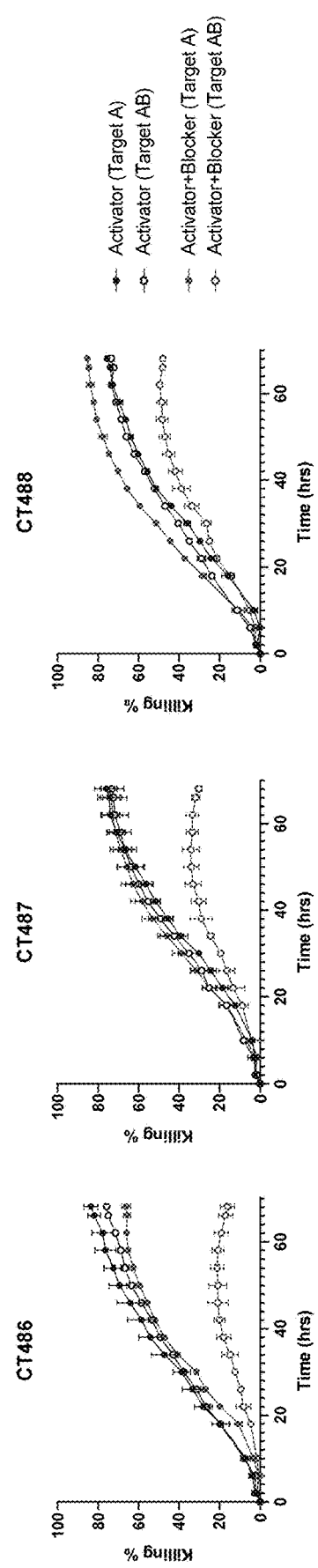
FIG. 10 is a series of plots showing cytotoxicity of T cells expressing either EGFR scFv CAR, or EGFR scFv CAR and HLA-A*02 scFv LIR1 inhibitory receptor, which were mixed 1:1 with HCT.116 cells expressing either EGFR (Target A) or EGFR and HLA-A*02 (Target AB).

The ability of the HLA-A*02 PA2.1 scFv LIR1 inhibitor (C1765) to block EGFR scFv CAR activation of T cells co-cultured with HCT.116 cells expressing either EGFR (Target A) or EGFR and HLA-A*02 (Target AB) was also assayed (FIG. 10). As with HeLa cells, different degree of blocking is observed when the same HLA-A*02 PA2.1 scFv LIR1 inhibitor was used with different EGFR activator receptors.

The ability of the HLA-A*02 PA2.1 scFv LIR1 inhibitor (C1765) to block EGFR scFv CAR activation of Jurkat cells when Jurkat cells were co-cultured with HeLa target cells was also assayed. The results are shown in FIG. 2. Similar to the results in primary T cells, a different degree of blocking is observed when the same HLA-A*02 PA2.1 scFv LIR1 inhibitor was used with different EGFR activator receptors.

Figure 6A:
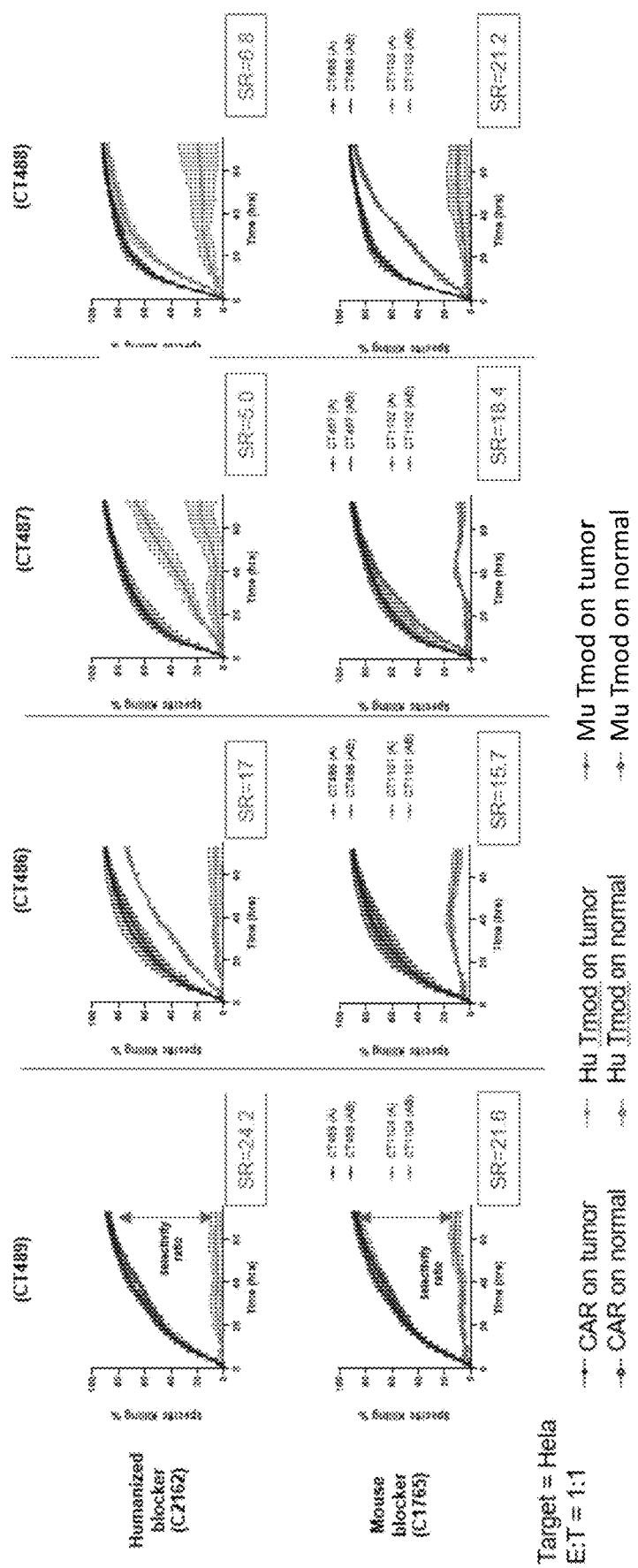
FIG. 6A is a series of plots that show that a different degree of blocking is observed when two different HLA-A*02 scFv LIR1 inhibitors are used with different EGFR scFv CAR activators in primary T cells.

Immune cell activation was measured in immune cells expressing an activator or a specific activator/blocker pair in the presence of a target cell expressing only an activating ligand or a target cell expressing both an activator ligand and a blocking ligand (FIG. 6A). Selectivity ratios (SR) were calculated for tested pairs of CAR activators and blockers. SR is determined by calculating the ratio of the activation of an immune cell expressing an activator/blocker pair in the presence of a target cell expressing only an activating ligand to the activation of an immune cell expressing the activator/blocker pair in the presence of a target cell expressing both an activator ligand and a blocking ligand. Selected EGFR targeting CAR activators were expressed as a pair with either a humanized blocker (C2162) or a mouse blocker (C1765). Among the EGFR targeting CAR activators paired with the humanized blocker, the selectivity ratio for CT489 reached 24.2; the selectivity ratio for CT486 reached 17; the selectivity ratio for CT487 reached 5.0; and the selectivity ratio for CT487 reached 5.0. Among the EGFR targeting CAR activators paired with the mouse blocker, the selectivity ratio for CT489 was 21.6; the selectivity ratio for CT486 was 15.7; the selectivity ratio for CT487 was 18.4; and the selectivity ratio for CT487 was 21.2 (FIG. 6A). The maximum specific killing was also determined for each of the EGFR targeting activator and inhibitory receptors pairs. For all pairings, the specific killing exceeded about 60%, indicating that choice of blocker did not significantly impact T cell activation by the EGFR targeting activator receptors. However, the pairing of a specific activator and specific blocker pair had an impact on the selectivity ratio, indicating that off-target killing by facilitated a specific activator/inhibitory receptor pair is not predictable.

Figure 6B:
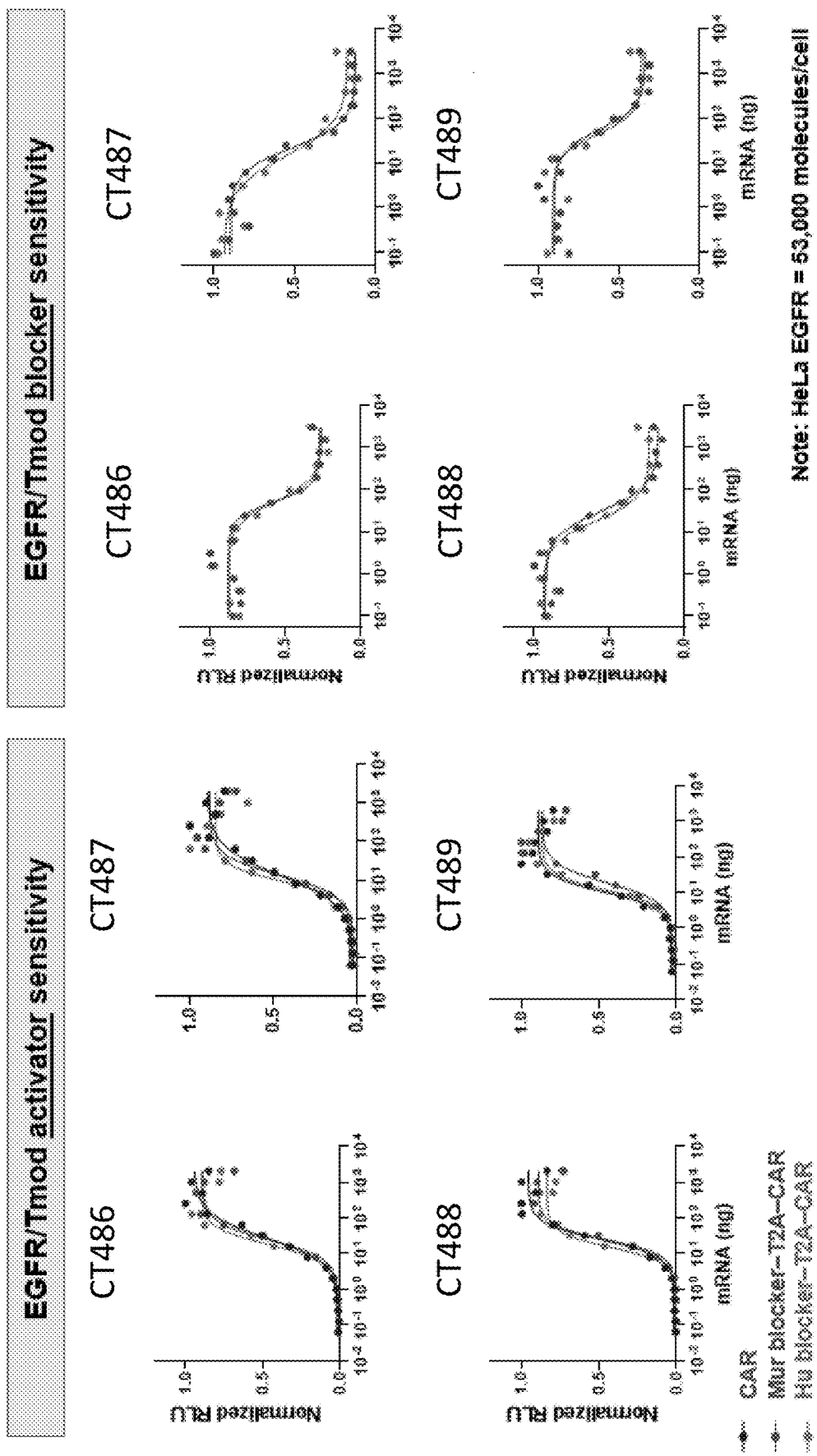
FIG. 6B is a series of plots that show the sensitivity of activating and inhibitory receptors when different pairs of activating and inhibitory receptors are co-expressed. Amount of activator or non-target antigen are varied on the target cells by mRNA titration.
Figure 6C:
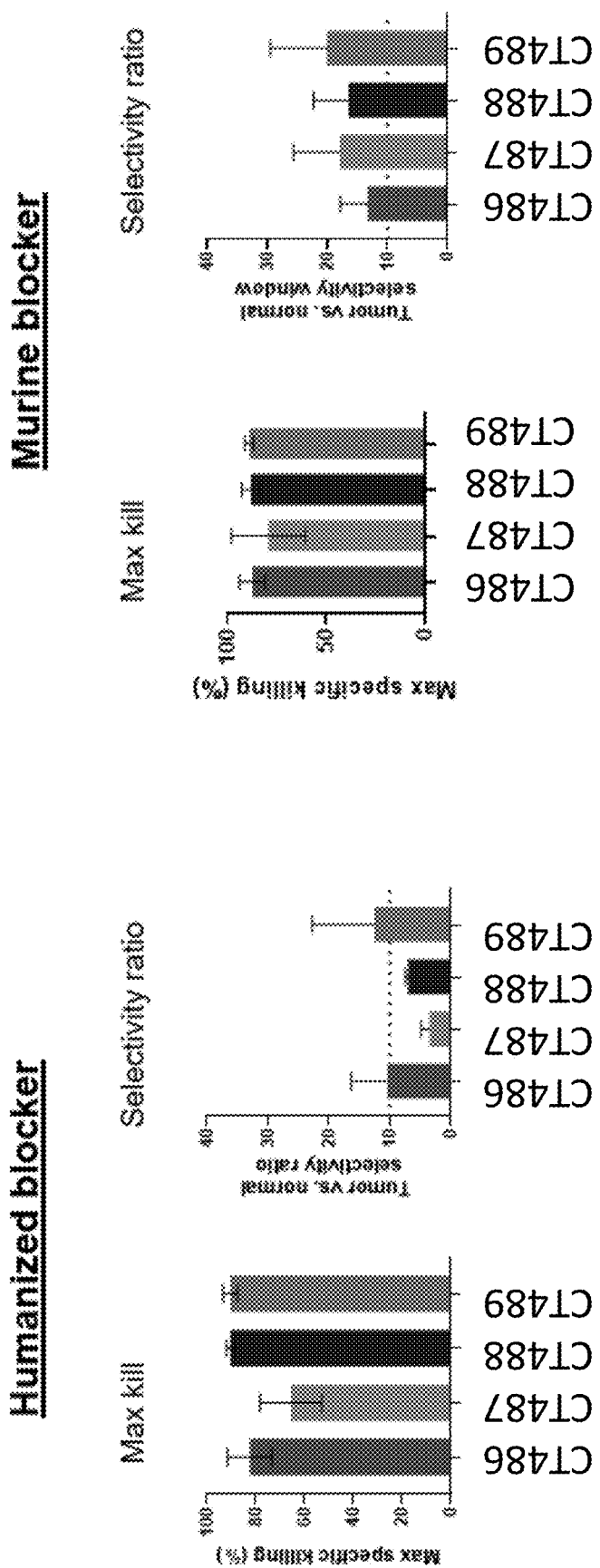
FIG. 6C is a series of charts showing the maximum specific killing (%) of target cells by cells expressing an EGFR targeting activator receptor and either a humanized inhibitory receptor or a murine inhibitory receptor. The selectivity ratio of target tumor cells vs. normal cells is also shown for each pair of activator and inhibitory receptors.
Figure 7:
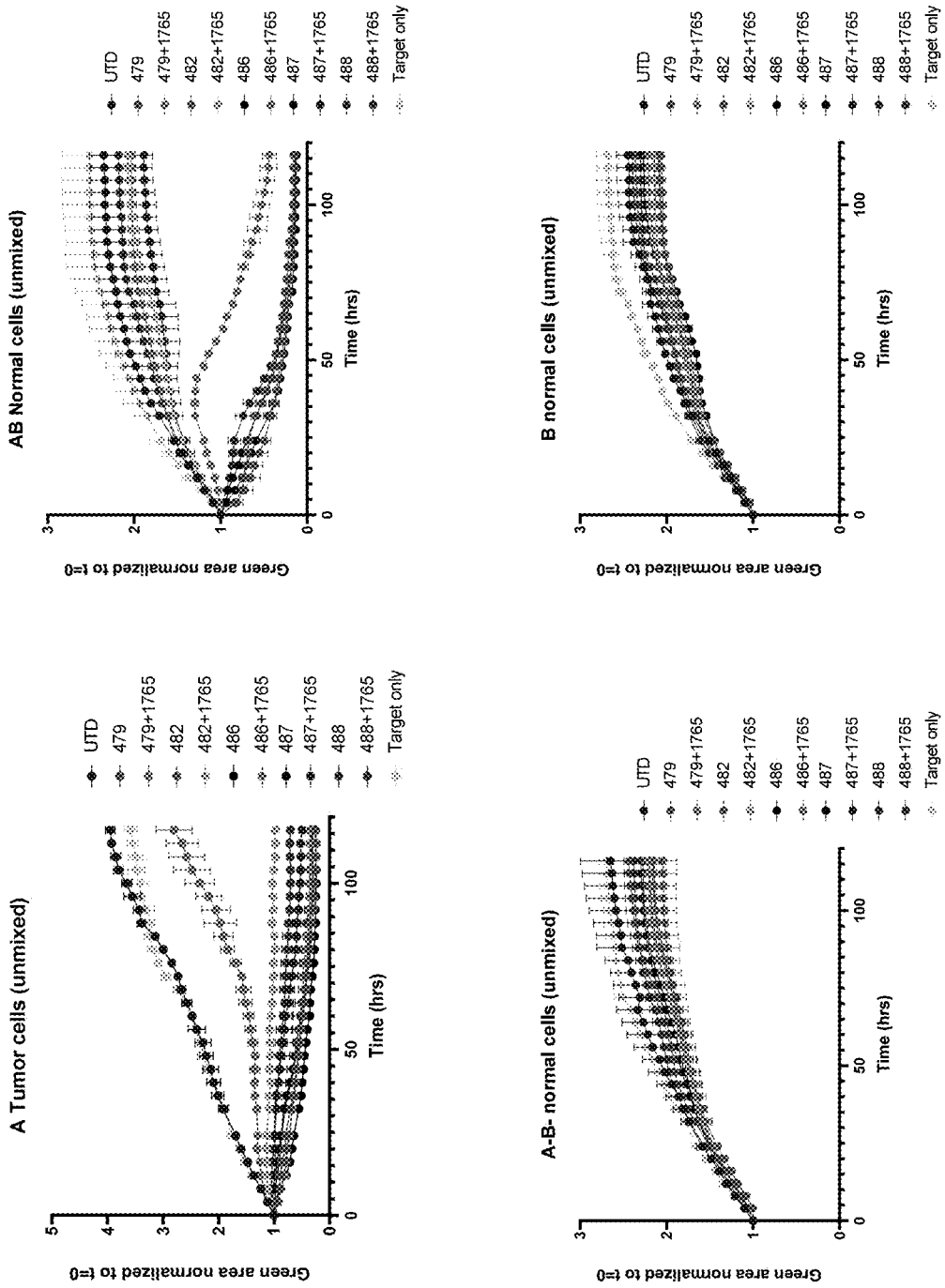
FIG. 7 is a series of plots showing cytotoxicity of T cells expressing either EGFR scFv CAR, or EGFR scFv Car and HLA-A*02 scFv LIR1 inhibitory receptors that were co-cultured with HeLa cells at a 1:1 ratio. A Tumor Cells: HeLa cells expressing EGFR and not HLA-A*02; AB Normal cells: HeLa cells expression EGFR and HLA-A*02; A-B− normal cells: HeLa cells that did not express either EGFR or HLA-A*02; B normal cells: HeLa cells expressing HLA-A*02 but not EGFR. Y axis shows green area, which is proportional to healthy HeLa cells in the assay. UTD: untransduced.
Figure 8:
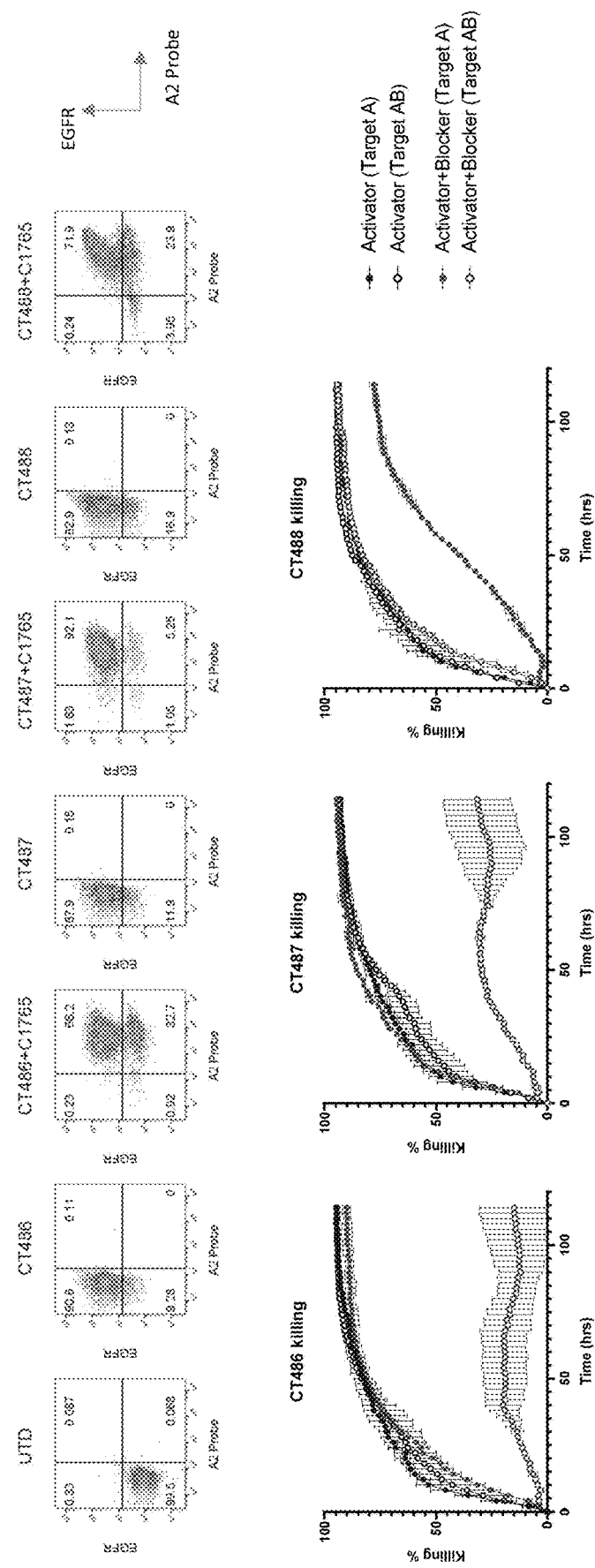
FIG. 8 is a series of plots showing the enrichment of primary T cells expressing blocker and activator receptors (top row), and the cytotoxic activity of these T cells expressing EGFR scFv CAR, or EGFR scFv CAR and HLA-A*02 scFv LIR1 inhibitory receptor, were mixed 1:1 with HeLa cells expressing either EGFR (Target A), or EGFR and HLA-A*02 (Target AB).
Figure 9:
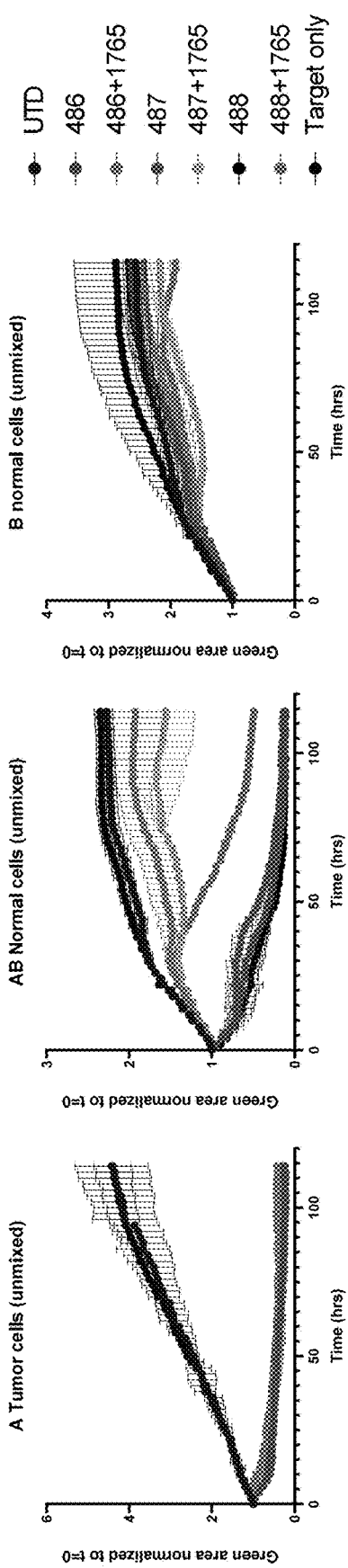
FIG. 9 is a series of plots showing cytotoxicity of T cells expressing either EGFR scFv CAR, or EGFR scFv CAR and HLA-A*02 scFv LIR1 inhibitory receptor, which were mixed 1:1 with HeLa cells expressing either EGFR, HLA-A*02, or both. A Tumor Cells: HeLa cells expressing EGFR and not HLA-A*02; AB Normal cells: HeLa cells expression EGFR and HLA-A*02; B normal cells: HeLa cells expressing HLA-A*02 but not EGFR. Y axis shows green area, which is proportional to healthy HeLa cells in the assay. UTD: untransduced.

Activator and blocker sensitivity was determined in immune cells expressing the CAR activator alone or the CAR activator and either a humanized blocker or a mouse blocker (FIG. 6B). To determine activator sensitivity immune cells were incubated in the presence of EGFR-negative target cells. Prior to incubation, target cells were titrated with EGFR mRNA, resulting in increasing levels EGFR expression (FIG. 6B, left panel). To determine blocker sensitivity immune cells were incubated in the presence of HLA-A*02 negative target cells that express EGFR (about 53,000 EGFR molecules per cell). Prior to incubation, target cells were titrated with HLA-A*02 mRNA, resulting in increasing levels HLA-A*02 expression (FIG. 6B, right panel). $EC_{50}$ values were calculated for each CAR activator and the blocker in combination with different CAR activators (Table 5.1). The results further confirm that the specific activator receptor has an impact on inhibitory receptor sensitivity.

TABLE 5.1

| Activator | Activator $EC_{50}$ (ng) | Mouse Blocker $EC_{50}$ (ng) | Human Blocker $EC_{50}$ (ng) |
| --- | --- | --- | --- |
| CT486 | 5,300 | 4,700 | 4,000 |
| CT487 | 3,500 | 3,500 | 2,900 |
| CT488 | 4,700 | 4,700 | 3,500 |
| CT489 | 3,100 | 4,200 | 3,200 |

Figure 11A:
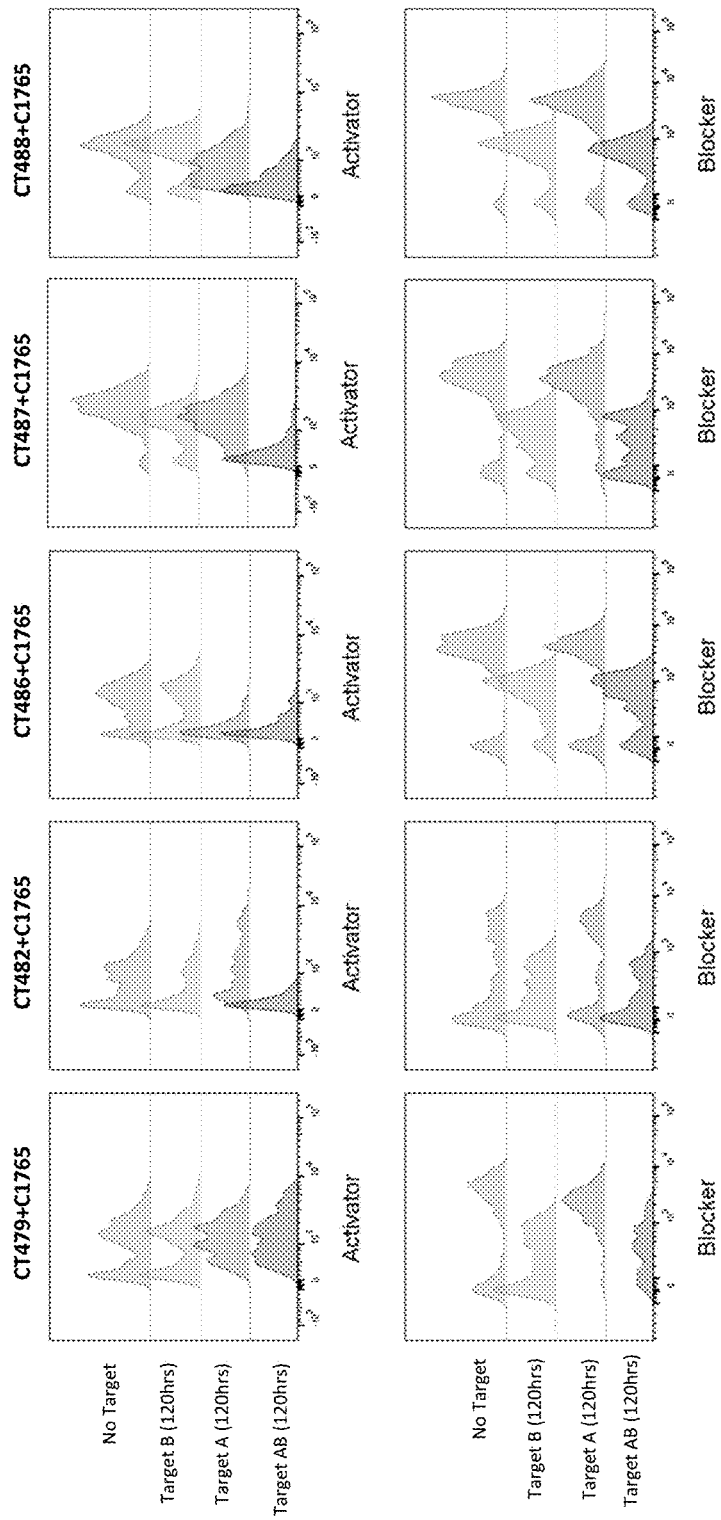
FIG. 11A is a series of fluorescence activated cell sorting (FACS) plots showing expression of EGFR scFv CAR activator receptor by T cells following incubation of T cells expressing different EGFR scFv CAR and an HLA-A*02 scFv LIR1 inhibitor with HeLa cells expressing EGFR activator alone (Target A), inhibitor target alone (Target B) or activator and inhibitor targets (Target AB).
Figure 11B:
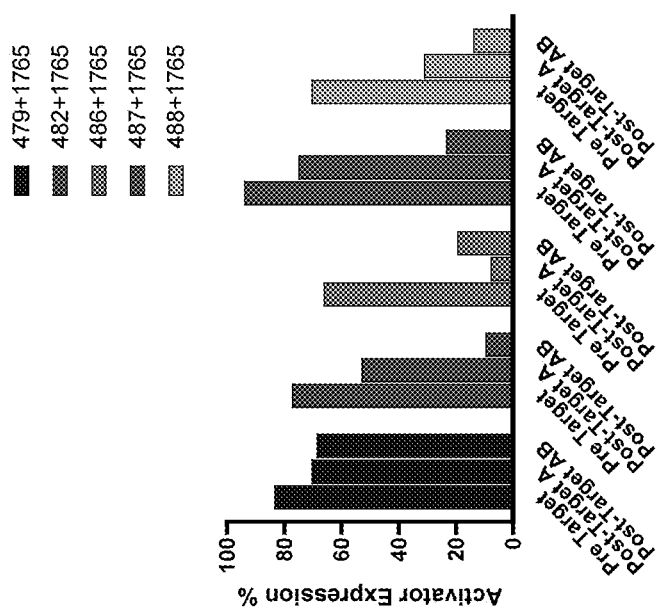
FIG. 11B is a plot showing quantification activator receptor expression before exposure to target cells, and after 120 hours co-culture with target cells expressing activator ligand alone (Target A), or target cells expressing both activator and blocker ligands (Target AB).

Example 6: Inhibitory Receptors Reversibly Decrease Surface Level of Activator Receptors in T Cells Primary T cells from two HLA-A*02 negative donors were transduced with an EGFR scFv CAR activator (CT-479, CT-482, CT-486, CT-487 or CT-488) and an HLA-A*02 PA2.1 scFv LIR1 inhibitor (C1765). Transduced cells were enriched by FACS sorting on the blocker and activator receptors, or by double column purification on the blocker and activator receptors. Transduced T cells were co-cultured with HeLa target cells. Normal HeLa cell lines express EGFR but not HLA-A*02, but were transduced to express the HLA-A*02 inhibitory receptor target. Cells were co-cultured at a 1:1 ratio of effector to target (E:T). Surface expression of the EGFR CAR activator was assayed after 120 hours using labeled peptides that bound the activator and inhibitory receptors, and fluorescence activated cell sorting. The change in activator surface level following co-culture with HeLa cells expressing both activator and blocker ligands corresponded to the T cells' ability to kill target cells (compare FIG. 5 and FIG. 11A).

Figure 12B:
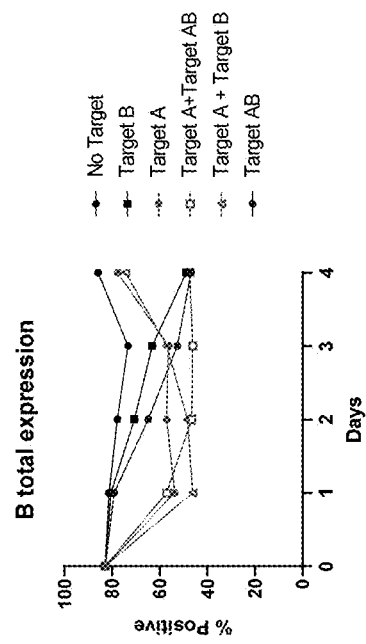
FIG. 12B is a plot showing cell surface expression of the inhibitory receptor on T cells expressing an EGFR scFv CAR (CT-482) activator and HLA-A*02 scFv LIR1 inhibitor (C1765) following co-culture with to populations of HeLa cells expressing EGFR (Target A), HLA-A*02 (Target B), a combination of EGFR and HLA-A*02 on the same cell (Target AB), a mixed population of HeLa cells expressing Target A and Target AB on different cells, or a mixed population of HeLa cells expressing Target B and Target AB on different cells.
Figure 12A:
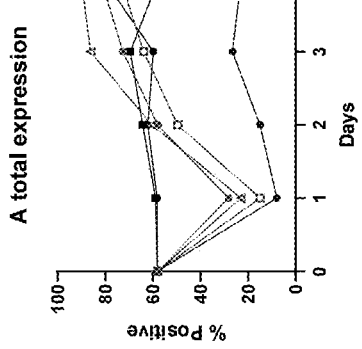
FIG. 12A is a plot showing cell surface expression of the activator receptor on T cells expressing an EGFR scFv CAR (CT-482) activator and HLA-A*02 scFv LIR1 inhibitor (C1765) following co-culture with populations of HeLa cells expressing EGFR (Target A), HLA-A*02 (Target B), a combination of EGFR and HLA-A*02 on the same cell (Target AB), a mixed population of HeLa cells expressing Target A and Target AB on different cells, or a mixed population of HeLa cells expressing Target B and Target AB on different cells.

T cells expressing the CT-482 EGFR scFv CAR activator and HLA-A*02 PA2.1 scFv LIR1 inhibitor (C1765) combination, were co-cultured with HeLa cells expressing EGFR (Target A), HLA-A*02 (Target B), a combination of EGFR and HLA-A*02 on the same cell (Target AB), a mixed population of HeLa cells expressing Target A and Target AB on different cells, or a mixed population of HeLa cells expressing Target B and Target AB on different cells (FIGS. 12A-12B). T cells were cultured with HeLa target cells at a ratio of 1:1 effector cell to target cell. When T cells were co-cultured with a Target A plus Target AB population of HeLa cells, levels of activator decreased, then recovered (FIG. 12A). Furthermore, the activator and blocker antigens must be present together on the same cell to trigger activator surface expression loss on effector T cells. In contrast to the activator, blocker expression was largely unchanged (FIG. 12B).

Figure 13:
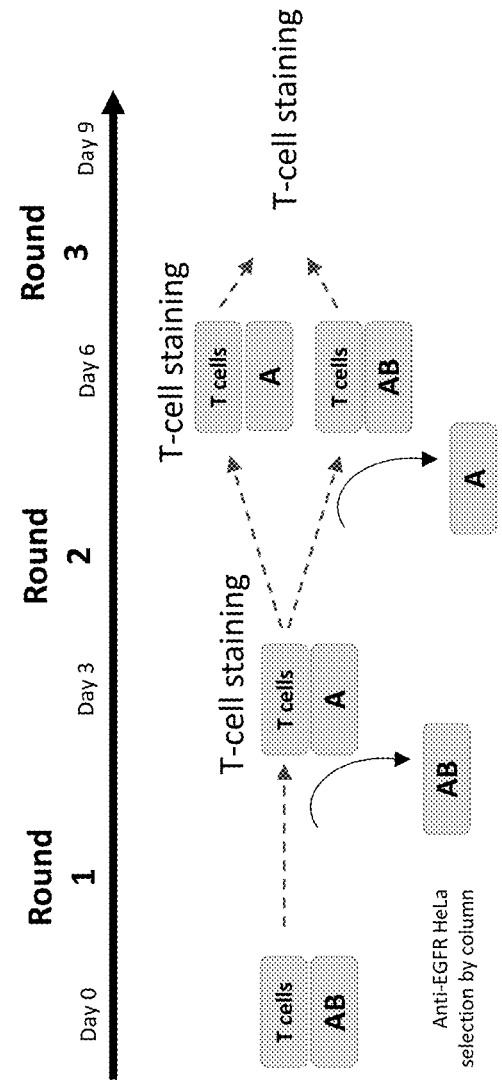
FIG. 13 is a diagram of an experiment to determine if cytotoxicity or blocking activity by T cells was reversible.
Figure 14A:
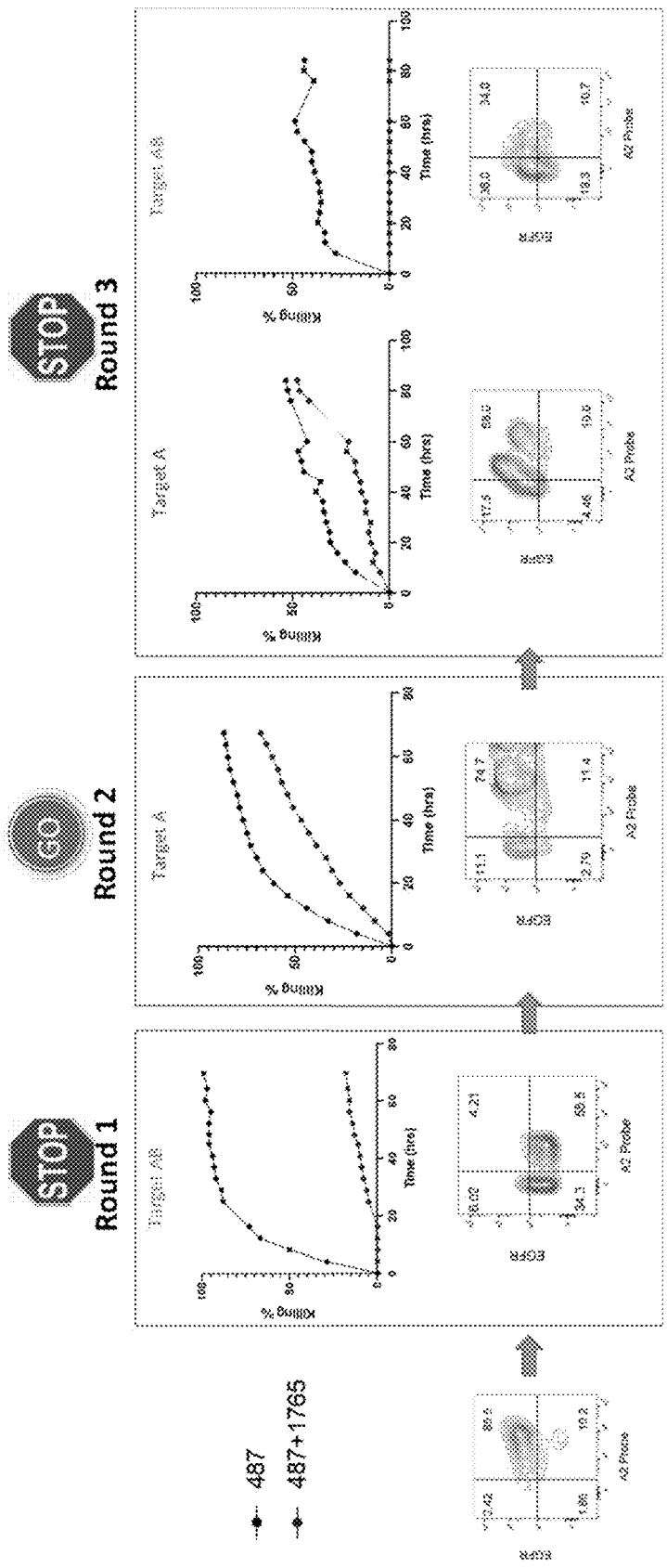
FIG. 14A is a series of plots showing that cytotoxicity and blocking activity is reversible and correspond to activator surface expression. The T cells were co-cultured with EGFR+/HLA-A2+ target cells in round 1, then switched to alternating target cells in the following rounds. At top: percent killing of target HeLa cells by T cells is shown. At bottom: activator and inhibitory receptor expression as assayed by FACS.
Figure 14B:
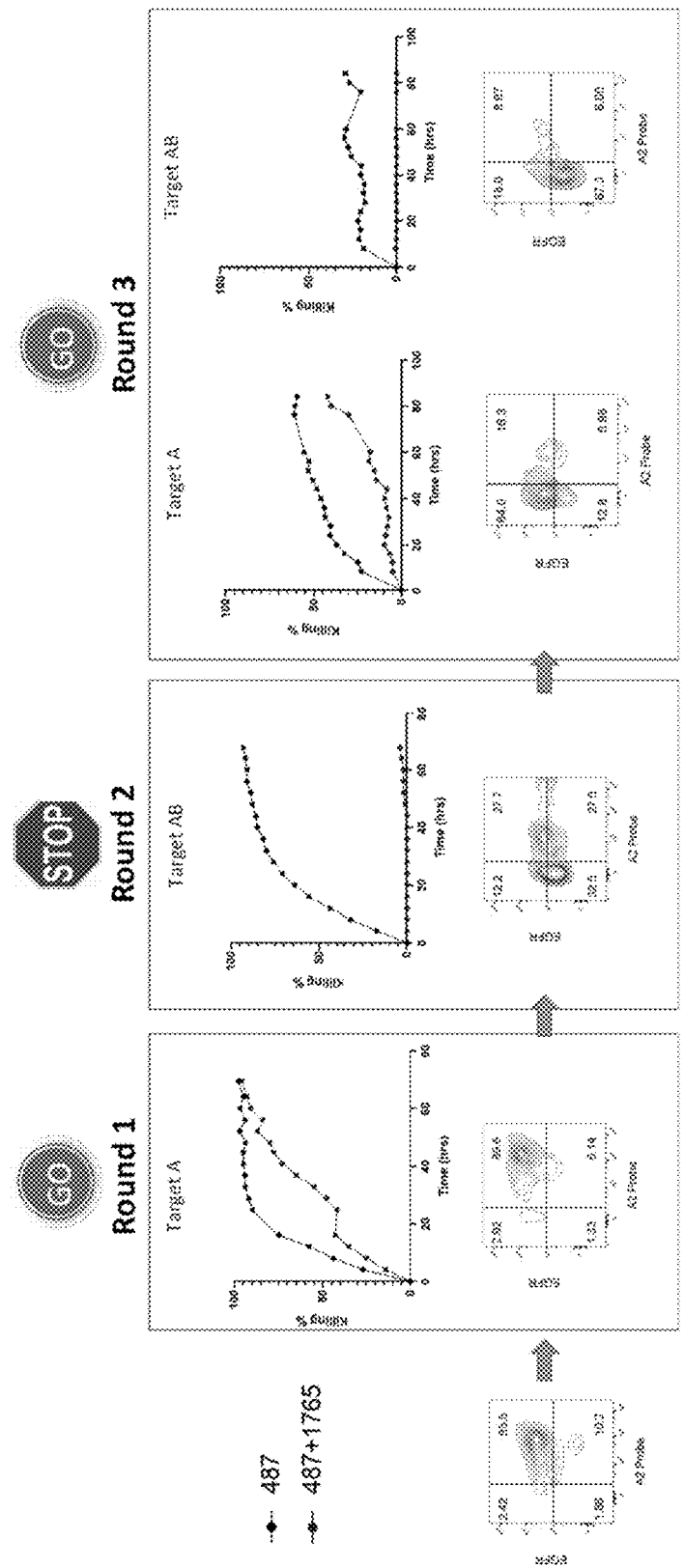
FIG. 14B is a series of plots showing that cytotoxicity and blocking activity is reversible and correspond to activator surface expression. The T cells were co-cultured with EGFR+/HLA-A2− target cells in round 1, then switched to alternating target cells in the following rounds. At top: percent killing of target HeLa cells by T cells is shown. At bottom: activator and inhibitory receptor expression as assayed by FACS.

FIG. 13 shows a schematic for an experiment to determine if loss of cytotoxicity, blocking activity, and expression of activator receptor by T cells was reversible. T cells expressing EGFR scFv CAR activator receptor (CT-487) and HLA-A*02 PA2.1 scFv LIR1 (C1765) inhibitory receptor were co-cultured with HeLa target cells expressing both the activator and inhibitory receptor targets (AB). Following 3 days co-culture, HeLa cells were removed using an anti-EGFR column, and the T cells were either stained for the activator and inhibitory receptors, or co-cultured with HeLa cells expressing EGFR activator target only for an additional 3 days. After the additional 3 days co-culture, HeLa cells were again removed using an anti-EGFR column, and the T cells were either stained for the activator and inhibitory receptors, or were co-cultured for an additional 3 days with HeLa cells expressing EGFR activator target only, or both the activator and blocker targets (AB), before staining. T cells were assayed for the presence of activator and inhibitory receptors (stained) using labeled EGFR and A2 probes, and the levels of receptor expression were quantified using fluorescence activated cell sorting. Results of the experiment are shown in FIGS. 14A-14B. As shown in FIGS. 14A-14B, co-culture of T cells with HeLa cells expressing both activator and inhibitor targets reduces EGFR activator staining (FIGS. 14A-14B, left panel). When T cells are co-cultured with HeLa cells expressing activator (Target A only) at round 2, expression of EGFR activator increases. Thus, activator surface loss is reversible and tracks with T cell cytotoxicity.

Figure 15A:
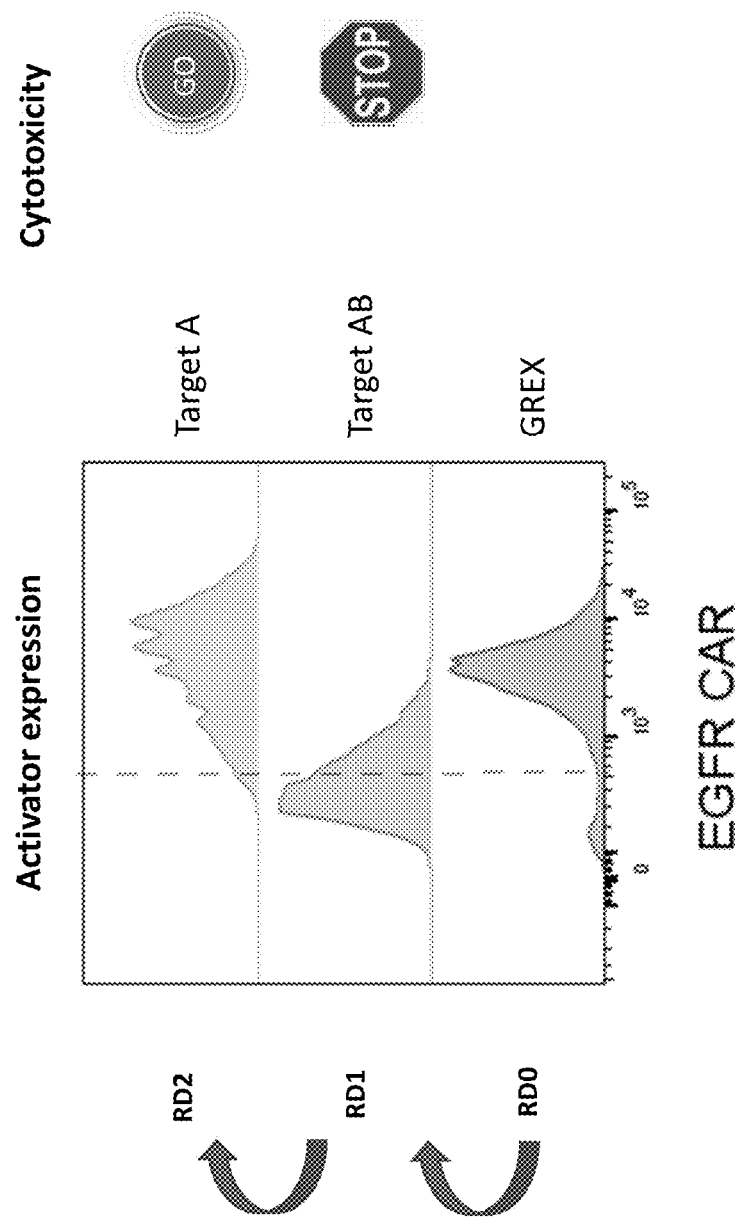
FIG. 15A is a plot showing that expression of EGFR activator CAR on the cell surface is reversibly downregulated by the presence of target cells expressing both activator and inhibitor ligands.
Figure 15B:
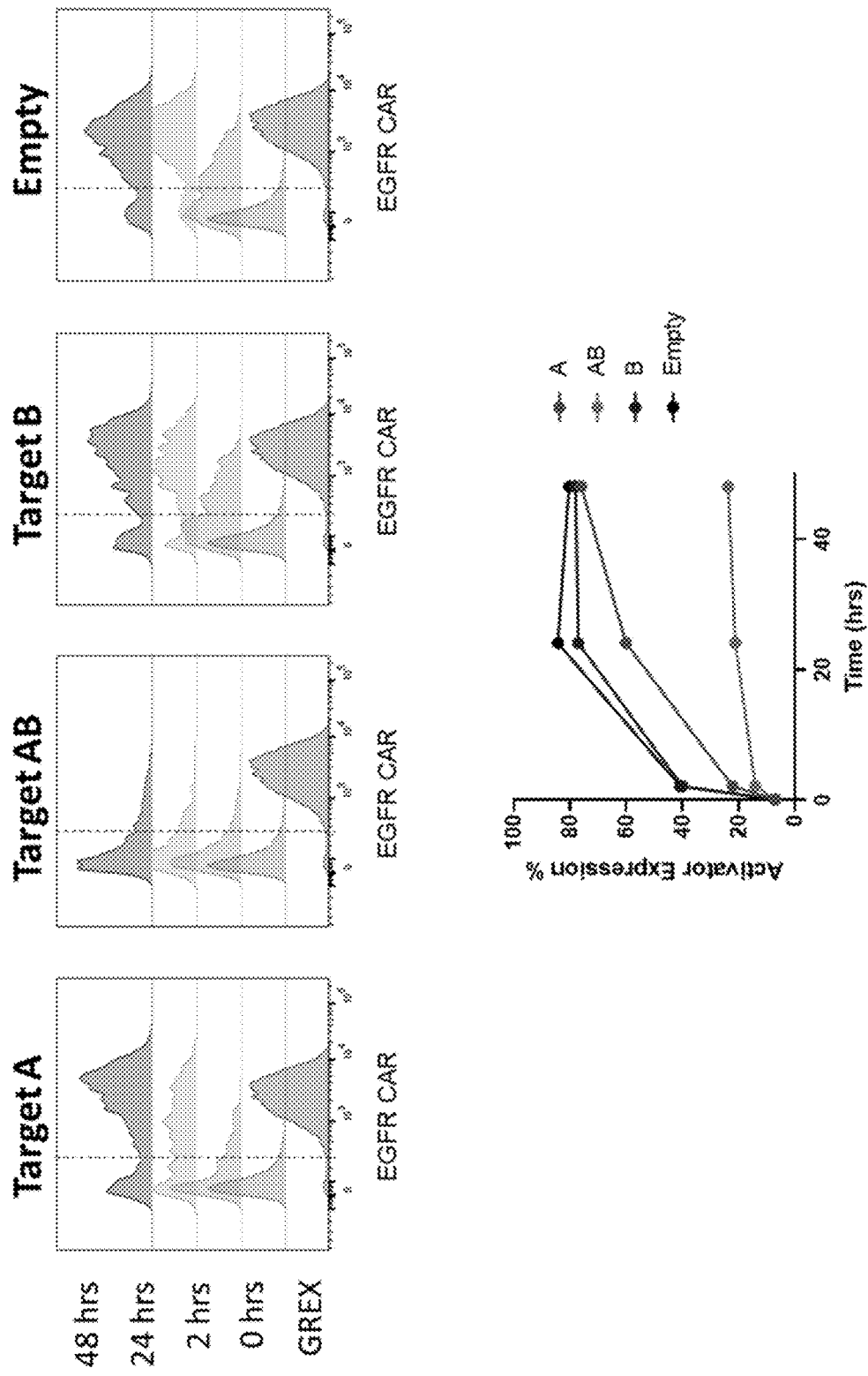
FIG. 15B is a series of plots showing that EGFR activator CAR expression on the cell surface is quickly restored when activator only target cells are present, or target cells expressing activator and blocker targets are not present.

FIGS. 15A-15B show the results of an additional experiment showing that loss of activator receptor expression is rapidly reversible. Activator CAR cell surface expression is diminished in T cells expressing both activator and inhibitory receptors when these T cells were co-cultured with model "normal" cells expressing both activator and inhibitor ligand. However, when T cells were switched to co-culture with model "cancer" cells that only express the activator ligand, the T cells were able to quickly (within hours) restore cell surface expression of the activator CAR. The absence of model "normal" cells expressing both activator and inhibitor ligand could also restore cell surface expression of the activator CAR, regardless of presence of tumor cells, within similar time frame.

Example 7: HLA-A*02 LIR-1 Based Inhibitory Receptors can Block Activation by an EGFR CAR Activator Activation of Jurkat effector cells expressing an EGFR CAR activator and a pMHC HLA-A*02 scFv LIR-1 based inhibitory receptor (comprising a LIR-1 hinge, transmembrane and ICD) was assayed using the NFAT Luciferase assay described in Example 3.

Figure 16:
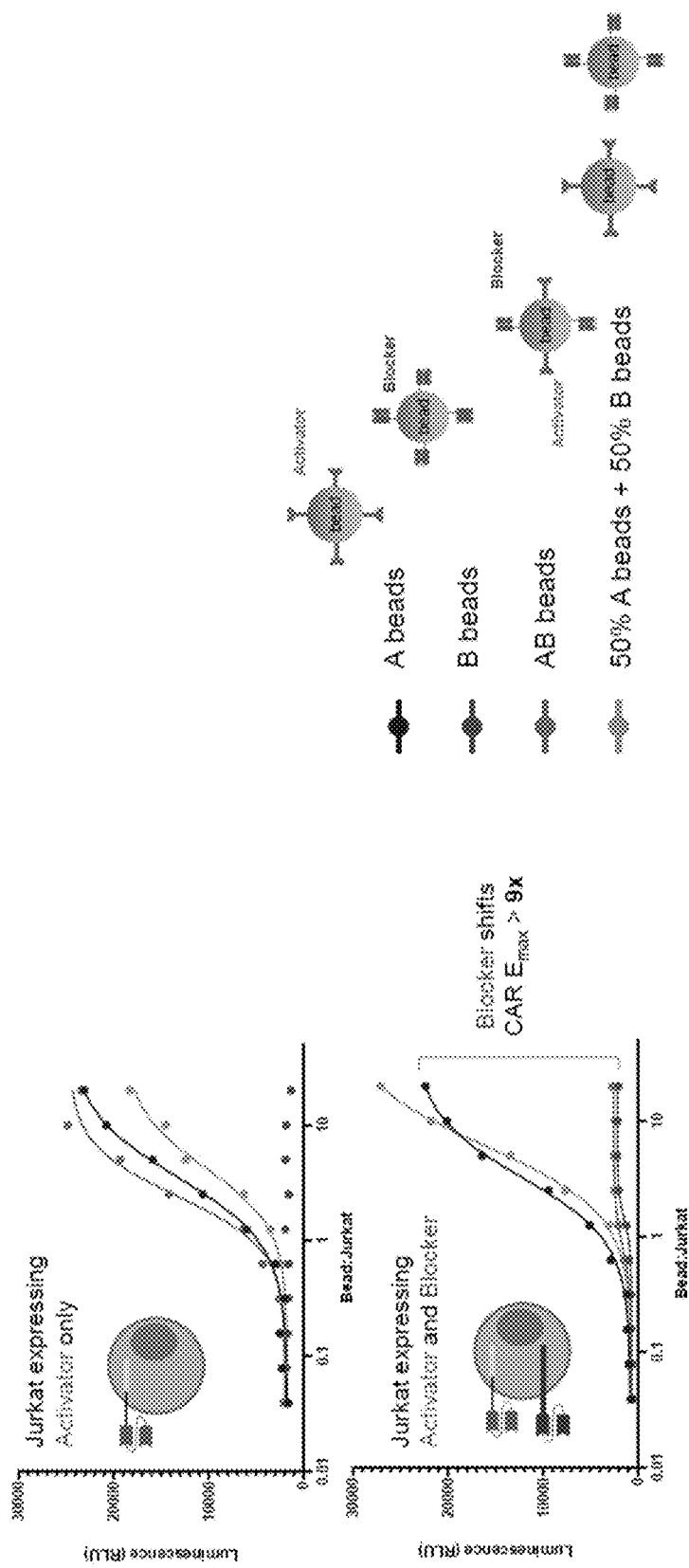
FIG. 16 shows that activation of Jurkat cells expressing an EGFR scFv CAR using a bead based assay can be blocked by a pMHC HLA-A*02 scFv LIR-1 based inhibitory receptor when the activator and inhibitor antigens are present on beads in cis, but not when the activator and inhibitor antigens are present on the beads in trans.

Jurkat cells were transfected with activator and inhibitory receptor DNA, and activation was assayed in a cell-free bead-based assay (FIG. 16). Beads were loaded with either activator antigen, blocker antigen, or activator and inhibitor antigens, and the ratio of beads to Jurkat cells was varied. In the cell-free bead based assay, the HLA-A*02 scFv LIR-1 based inhibitory receptor was able to block activation of the Jurkat cells when cells were contacted with beads carrying the HLA-A*02 blocker and EGFR activator in cis, but not when the HLA-A*02 blocker and EGFR activator were in trans (on different beads). Presence of the HLA-A*02 blocker on the beads was able to shift $E_{MAX}$ of EGFR CAR by greater than or equal to 9× (FIG. 16).

Activation of Jurkat cells expressing the EGFR CAR activator and an HLA-A*02 scFv LIR-1 based inhibitory receptor was also assayed using HeLa and SiHa cells as target cells. Normal HeLa and SiHa cell lines express EGFR but not HLA-A*02 (SiHa WT and HeLa WT), but were transduced to express the HLA-A*02 inhibitory receptor target (SiHa A02 and HeLa A02). As can be seen in FIG. 17A and FIG. 17B, the HLA-A*02 scFv LIR-1 based inhibitory receptor was able to shift the EGFR $E_{MAX}$ by greater than 4× using SiHa target cells (FIG. 17A) and greater than 5× using HeLa target cells (FIG. 17B).

Figure 19:
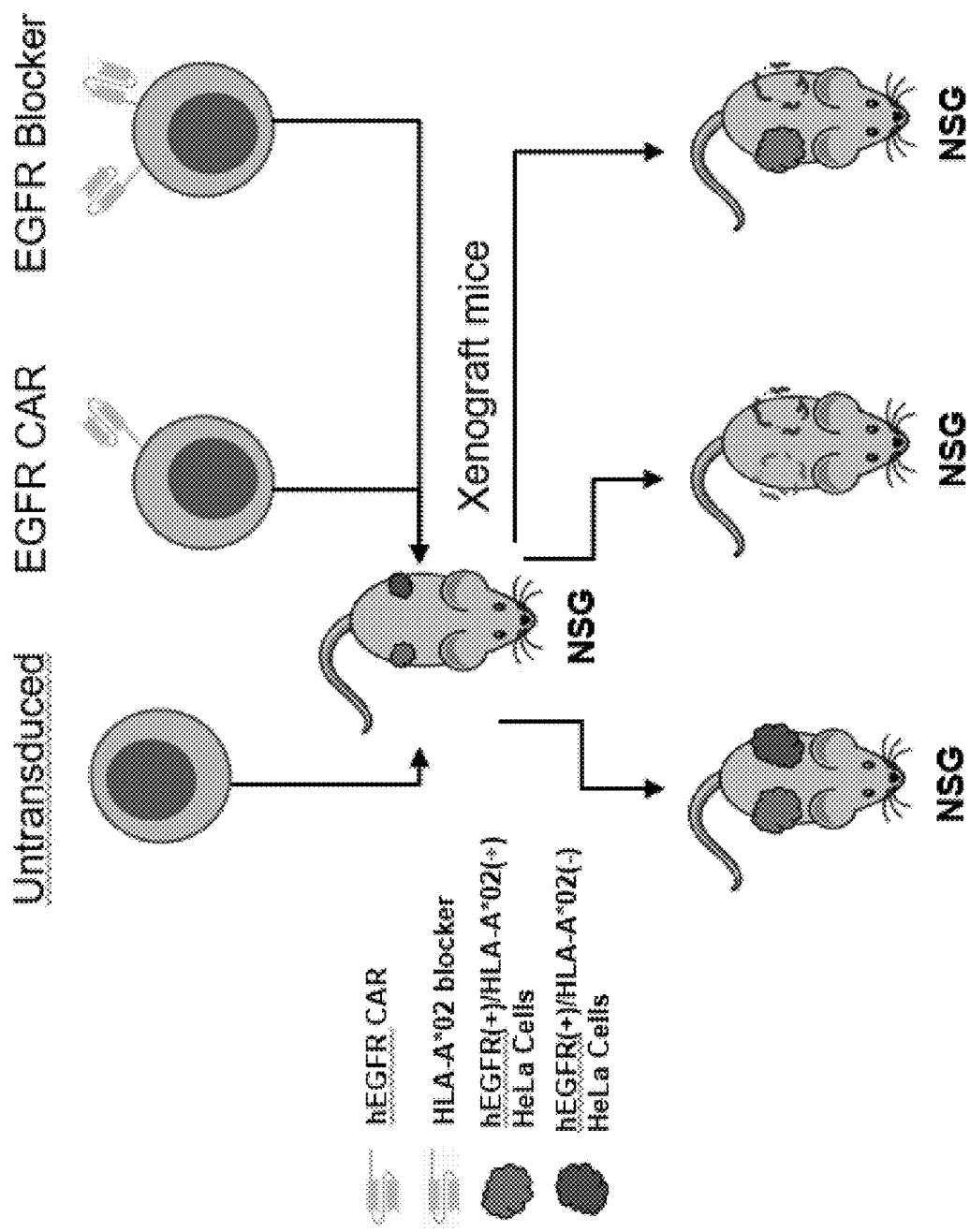
FIG. 19 is a diagram showing the experimental design for determining efficacy and selectivity of immune cells expressing an EGFR targeting activator receptor and a inhibitory receptor in vivo.

Example 8: In Vivo Efficacy of EGFR CAR Activator and Inhibitory Receptor Expressing T Cells Efficacy and tumor vs. normal cell selectivity for immune cells expressing activator receptors (EGFR CAR) and inhibitory receptor (Blocker) pairs are established in an in vivo environment (FIG. 19). A murine xenograft model in NSG (NOD.Cg-Prkdc$^{scid}$Il2rg$^{tm1Wjl}$/SzJ) using human EGFR+/HLA-A*02+ HeLa cells representing "normal" cells and isogenic EGFR+/HLA-A*02(−) knockout HeLa cells as "tumor" cells. The in vivo therapeutic window is established by comparing the effect of the for activator/inhibitory receptor pairs on normal vs tumor cells. These data provide in vivo support for an on-target, off-tumor therapeutic window. Optimal doses for activator/inhibitory receptor pairs are established and optimized for sensitivity and selectivity.

The in vivo model involves subcutaneous xenografts of "normal" cells in the right flank and "tumor" cells in the left flank. Immune cells expressing the activator receptor, an activator/inhibitory receptor pair, or untransduced control cells are administered to the animals at a range of time points.

Animals are monitored for general health via clinical observations and effects on body weight. Tumor xenotransplants are assessed for size by caliper and imaging. At each time point, human T cells are enumerated by flow cytometry and assessed for surface markers including CD3, CD4, CD8, activator receptor expression, and inhibitory receptor expression. Serum cytokine levels are determined, including IFNγ and interleukin-2 (IL-2). In post-life analysis, protocol-specified tissues, including the injection site and the tumor, are assessed by histology for tumor infiltrating T-cells and activator receptor antigen (e.g. EGFR) and blocker antigen expression (e.g. HLA-A*02) by an ACVP board-certified pathologist.

Example 9: B7 and HLA-A*11 are Inhibitory Receptor Ligands

An HLA-A*011 inhibitory receptor was created by fusing scFv #4 (Table) to a hinge, TM and ICD derived from LIR-1. Gene segments were combined using Golden Gate cloning and inserted downstream of a human EF1alpha promoter contained in a lentivirus expression plasmid.

Jurkat NFAT-Luciferase effector cells were transformed as described above with a CAR activator, or a CAR activator and the scFv #4 HLA-A*11 inhibitory (blocker) receptor. Sequences of the HLA-A*011 inhibitory receptor are shown in Table 9. 1, below. and co-cultured with HeLa cells expressing both the activator ligand and HLA-A*011:01. NFAT-Luciferase assays were carried out using HeLa instead of T2 target cells.

Figure 20A:
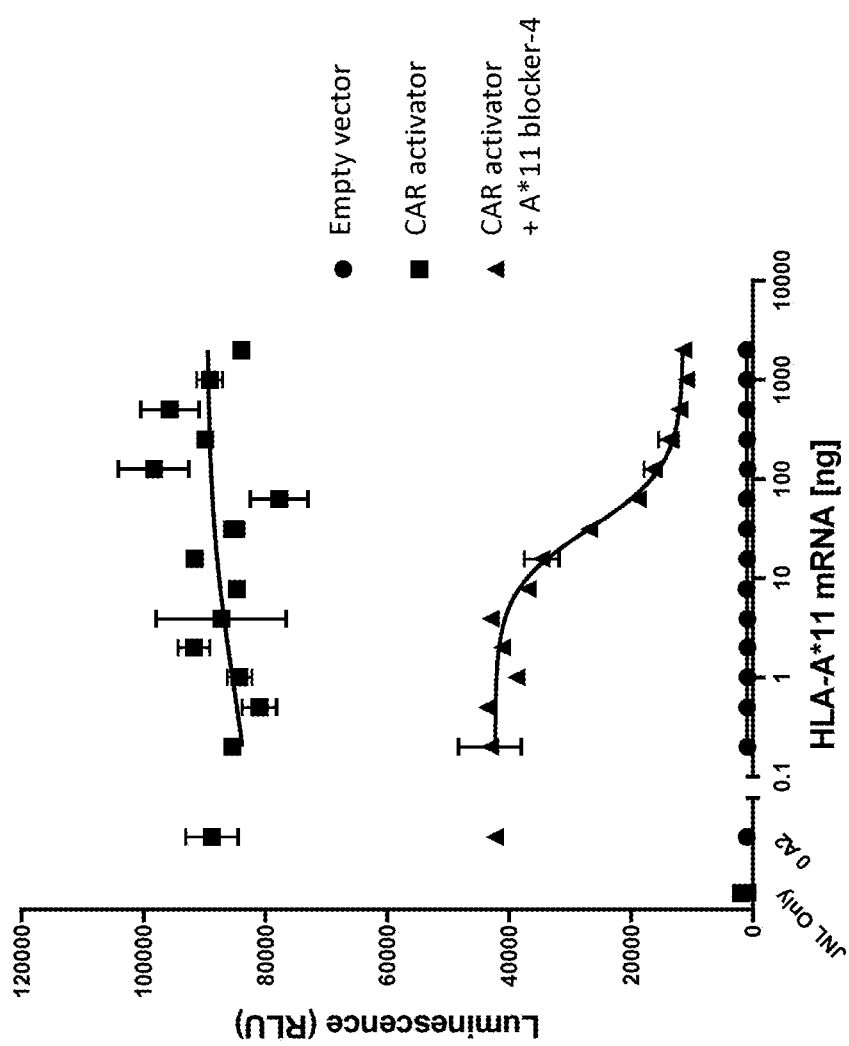
FIG. 20A is a plot showing Jurkat NFAT luciferase (JNL) cell inhibition in an mRNA titration assay using HeLa cells transfected with mRNA encoding HLA-A*11. HeLa cells were transfected with serially diluted HLA-A*11 mRNA, and JNL cells were transiently transfected with an EGFR activating CAR+/−HLA-A*11 inhibitory receptor with scFv HLA-A*11 #4. The functional response was assessed after a 6 hour co-culture.

Results are shown in FIG. 20A and FIG. 20B. As shown in FIG. 20A, scFv #4, when fused to LIR-1's hinge, TM and ICD domains, is capable of inhibiting activation of Jurkat effector cells co-cultured with target cells expressing both activator ligand and HLA-A*011.

TABLE 9.1

HLA-A*011 inhibitory receptor sequences.

| Name | Protein Sequence | DNA Sequence |
|---|---|---|
| HLA-A*11 Blocker 4 | MDMRVPAQLL | ATGGACATGAGGGTCCCCGCTCAGCTCCTGGGGCTC |
| | GLLLLWLRGA | CTGCTACTCTGGCTCCGAGGTGCCAGATGTGAAGTG |
| | RCEVQLVESGG | CAGCTGGTGGAAAGCGGCGGAGGCCTGGTGCAGCC |
| | GLVQPGGSLRLS | TGGCGGCAGCCTGAGACTGTCTTGCGCCGCCAGCGG |
| | CAASGFTFSSYW | CTTCACCTTCAGCAGCTACTGGATGCACTGGGTCCG |
| | MHWVRQAPGK | CCAGGCCCCTGGCAAGGGACTGGTCTGGGTGTCTCG |
| | GLVWVSRINSDG | AATCAACAGCGACGGCAGCAGCACCAGCTACGCCG |
| | SSTSYADSVKGR | ACAGCGTGAAGGGCCGGTTCACCATCAGCCGGGAC |
| | FTISRDNAKNTL | AACGCCAAGAACACCCTGTACCTGCAGATGAACAG |
| | YLQMNSLRAED | CCTGCGGGCCGAGGACACCGCCGTGTATTACTGTTG |
| | TAVYYCCLGVL | TTTGGGTGTTTTATTATACAACTGGTTCGACCCCTGG |
| | LYNWFDPWGQG | GGCCAGGGAACCCTGGTCACCGTGTCCTCAGGCGG |
| | TLVTVSSGGGG | AGGTGGAAGCGGAGGGGGAGGATCTGGCGGCGGAG |
| | SGGGGSGGGGS | GAAGCGGAGGCGACATCCAGATGACCCAGTCTCCA |
| | GGDIQMTQSPSS | TCCTCCCTGTCTGCATCTGTAGGAGACAGAGTCACC |
| | LSASVGDRVTIT | ATCACTTGCCGGGCAAGTCAGAGCATTAGCAGCTAT |
| | CRASQSISSYLN | TTAAATTGGTATCAGCAGAAACCAGGGAAAGCCCC |
| | WYQQKPGKAPK | TAAGCTCCTGATCTATGCTGCATCCAGTTTGCAAAG |
| | LLIYAASSLQSG | TGGGGTCCCATCAAGGTTCAGTGGCAGTGGATCTGG |
| | VPSRFSGSGSGT | GACAGATTTCACTCTCACCATCAGCAGTCTGCAACC |
| | DFTLTISSLQPED | TGAAGATTTTGCAACTTACTACTGTCAACAGAGTTA |
| | FATYYCQQSYST | CAGTACCCCTCTCACTTTCGGCGGCGGAACAAAGGT |
| | PLTFGGGTKVEI | GGAGATCAAGTACGGCTCACAGAGCTCCAAACCCT |
| | KYGSQSSKPYLL | ACCTGCTGACTCACCCCAGTGACCCCCTGGAGCTCG |
| | THPSDPLELVVS | TGGTCTCAGGACCGTCTGGGGGCCCCAGCTCCCCGA |
| | GPSGGPSSPTTGP | CAACAGGCCCCACCTCCACATCTGGCCCTGAGGACC |
| | TSTSGPEDQPLTP | AGCCCCTCACCCCCACCGGGTCGGATCCCCAGAGTG |

TABLE 9.1-continued

HLA-A*011 inhibitory receptor sequences.

| Name | Protein Sequence | DNA Sequence |
|---|---|---|
| | TGSDPQSGLGRH | GTCTGGGAAGGCACCTGGGGGTTGTGATCGGCATCT |
| | LGVVIGILVAVIL | TGGTGGCCGTCATCCTACTGCTCCTCCTCCTCCTCCT |
| | LLLLLLLLFLILR | CCTCTTCCTCATCCTCCGACATCGACGTCAGGGCAA |
| | HRRQGKHWTST | ACACTGGACATCGACCCAGAGAAAGGCTGATTTCC |
| | QRKADFQHPAG | AACATCCTGCAGGGGCTGTGGGGCCAGAGCCCACA |
| | AVGPEPTDRGLQ | GACAGAGGCCTGCAGTGGAGGTCCAGCCCAGCTGC |
| | WRSSPAADAQE | CGATGCCCAGGAAGAAAACCTCTATGCTGCCGTGA |
| | ENLYAAVKHTQ | AGCACACACAGCCTGAGGATGGGGTGGAGATGGAC |
| | PEDGVEMDTRSP | ACTCGGAGCCCACACGATGAAGACCCCCAGGCAGT |
| | HDEDPQAVTYA | GACGTATGCCGAGGTGAAACACTCCAGACCTAGGA |
| | EVKHSRPRREM | GAGAAATGGCCTCTCCTCCTTCCCCACTGTCTGGGG |
| | ASPPSPLSGEFLD | AATTCCTGGACACAAAGGACAGACAGGCGGAAGAG |
| | TKDRQAEEDRQ | GACAGGCAGATGGACACTGAGGCTGCTGCATCTGA |
| | MDTEAAASEAP | AGCCCCCCAGGATGTGACCTACGCCCAGCTGCACAG |
| | QDVTYAQLHSL | CTTGACCCTCAGACGGGAGGCAACTGAGCCTCCTCC |
| | TLRREATEPPPS | ATCCCAGGAAGGGCCCTCTCCAGCTGTGCCCAGCAT |
| | QEGPSPAVPSIY ATLAIH (SEQ ID NO: 915) | CTACGCCACTCTGGCCATCCAC (SEQ ID NO: 916) |

Figure 21:
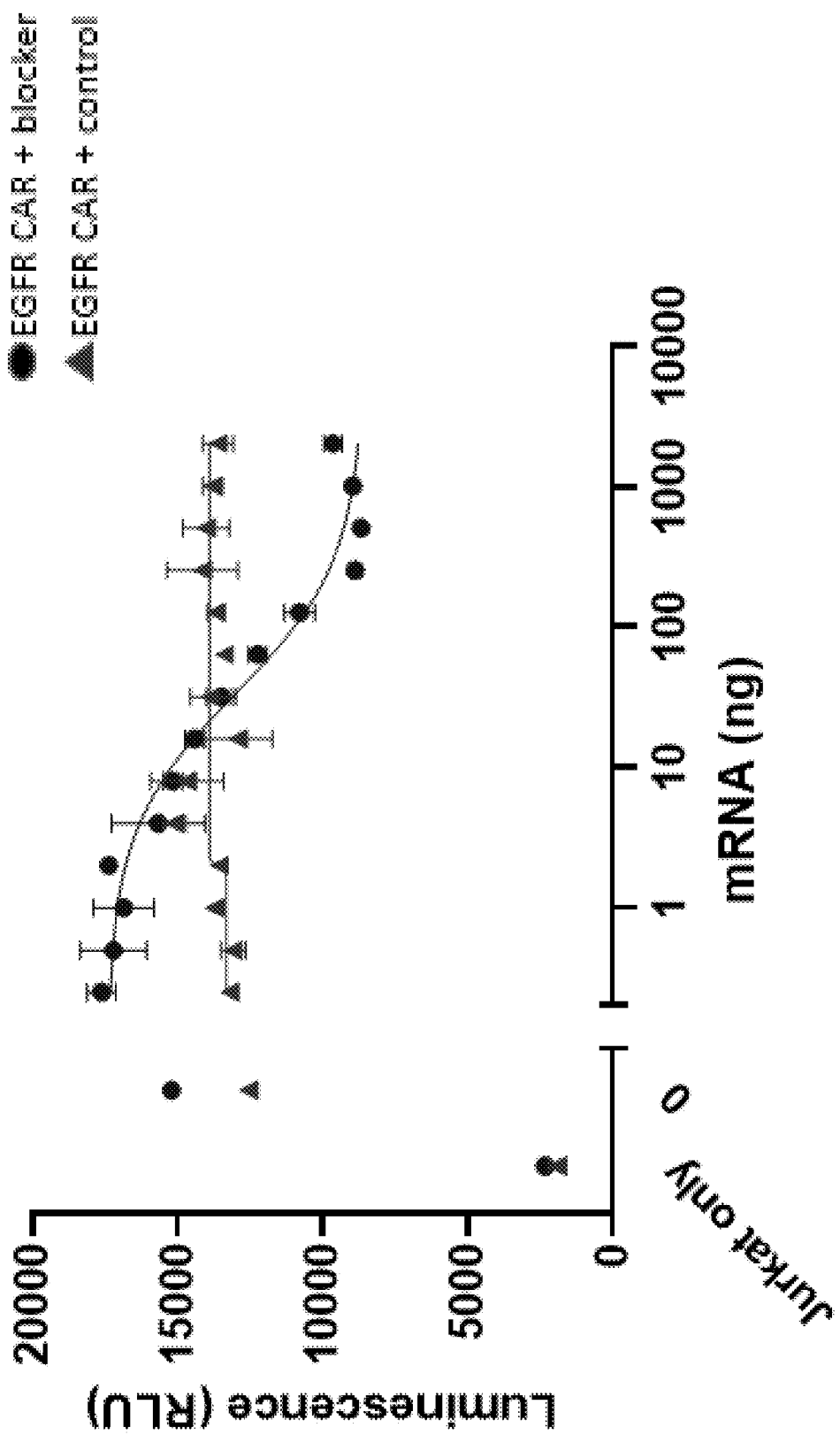
FIG. 21 is a plot showing that an HLA-B*07-scFv-LIR1 inhibitory receptor inhibits immune cell activation mediated by a co-expressed EGFR targeting activator receptor.

Jurkat NFAT luciferase (JNL) cell activation was measured in an mRNA titration assay using HeLa cells transfected with mRNA. HeLa cells were transfected with serially-diluted mRNA encoding HLA-B*07:02. JNL cells were transiently transfected with the EGFR activating CAR and HLA-B*07 blocker (circle) or negative control vector (triangle). The functional response was assessed after a 6 hour co-culture. The results shown in FIG. 21 demonstrate that HLA-B*07 blocker blocks activation of the EGFR targeting CARs in the presence of titrated HLA-B*07:02 but not in the absence of blocker.

Example 10: Characterization of EGFR Activator and HLA-A*02 Inhibitory Receptor Expression in Primary T Cells To stain for EGFR activator, primary T cells were incubated with EGFR-Fc (R&D Systems) at 1:25 dilution for 30 minutes at room temperature in FACS buffer (1% BSA in PBS). Cells were washed 2 times in FACS buffer and incubated in anti-Fc (1:100) for 30 minutes at room temperature in FACS buffer. To stain for HLA-A*02 inhibitory receptor, T cells were incubated with HLA-A*02 tetramer probe for 30 minutes at room temperature in FACS buffer. Receptor expressions were analyzed by flow cytometry after staining.

Figure 22:
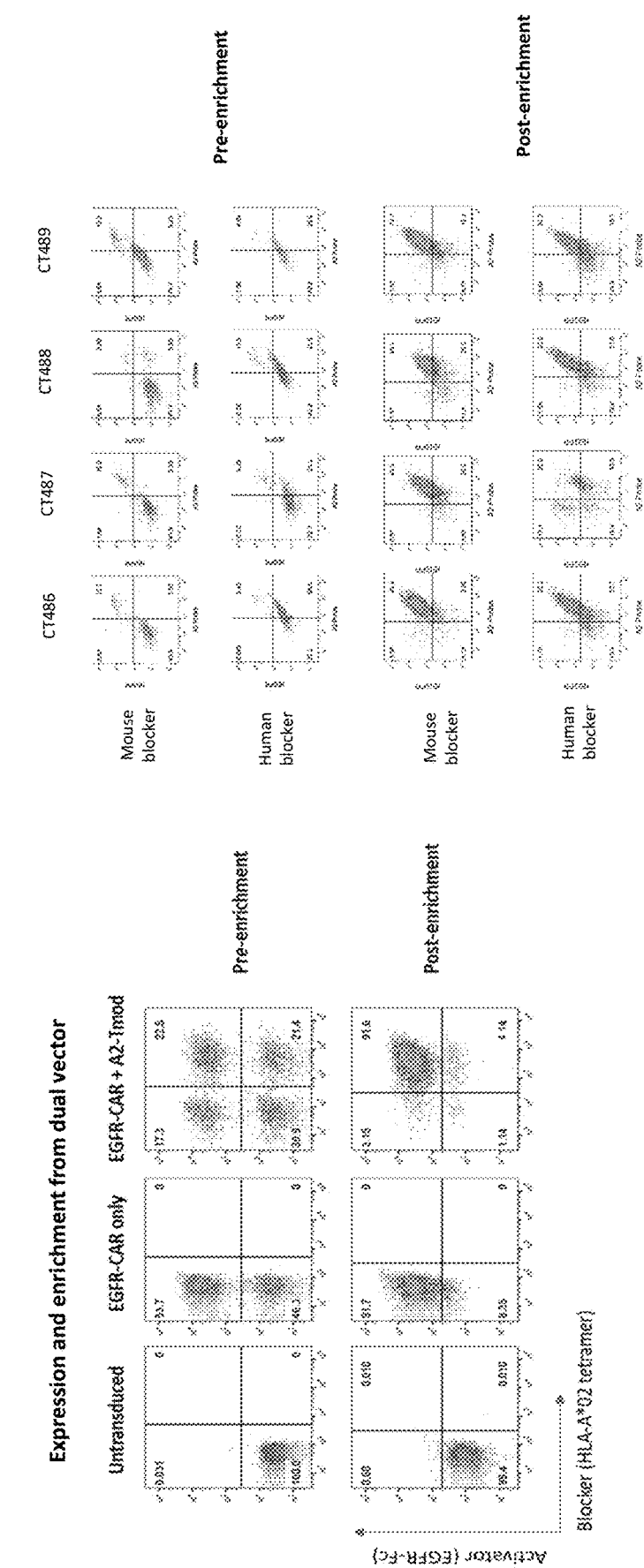
FIG. 22 is a series of plots showing the expression of EGFR activator receptors (EGFR-CAR only) and EGFR activator/HLA-A inhibitory receptor pairs in primary T cells comprising vectors disclosed herein. Percent of cells expressing one or both receptors are shown before enrichment (pre-enrichment) and after enrichment (post-enrichment), where the enrichment selects for cells expressing the receptors. Receptor pairs are expressed from either two separate vectors (dual vector) or one vector (single vector).

Primary T cells were transduced with polynucleotides encoding an EGFR targeting activator receptor and either a human or mouse HLA-A*02 targeting inhibitory receptor. Several specific pairs of EGFR targeting activators and HLA-A*02 targeting inhibitory receptors were tested. Transduction was performed with either a single vector encoding both the activator receptor and inhibitory receptor or two vectors, one encoding the activator receptor and one encoding the inhibitory receptor. Cells were analyzed with and without enrichment to determine the percentage of cells expressing both the activator and inhibitor receptor (FIG. 22).

In primary T cells transduced with two vectors, one encoding the activator receptor and one encoding the inhibitory receptor, the percentage of cells in the transduced T cell population expressing both receptors was about 22.5% (FIG. 22A, left panel) prior to enrichment. Following enrichment, the percentage of cells in the transduced T cell population expressing both receptors increased to about 91.6%

In primary T cells transduced with the single vector encoding both the activator receptor and inhibitory receptor, the percentage of cells in the transduced T cell population expressing both receptors ranged between about 6.29% and 13.2% prior to enrichment. Following enrichment, the percentage of cells expressing both receptors ranged from 22.6% to 82.8%. The percentage of cells expressing both receptors was dependent on the specific activator and inhibitory receptor pair.

Figure 23A:
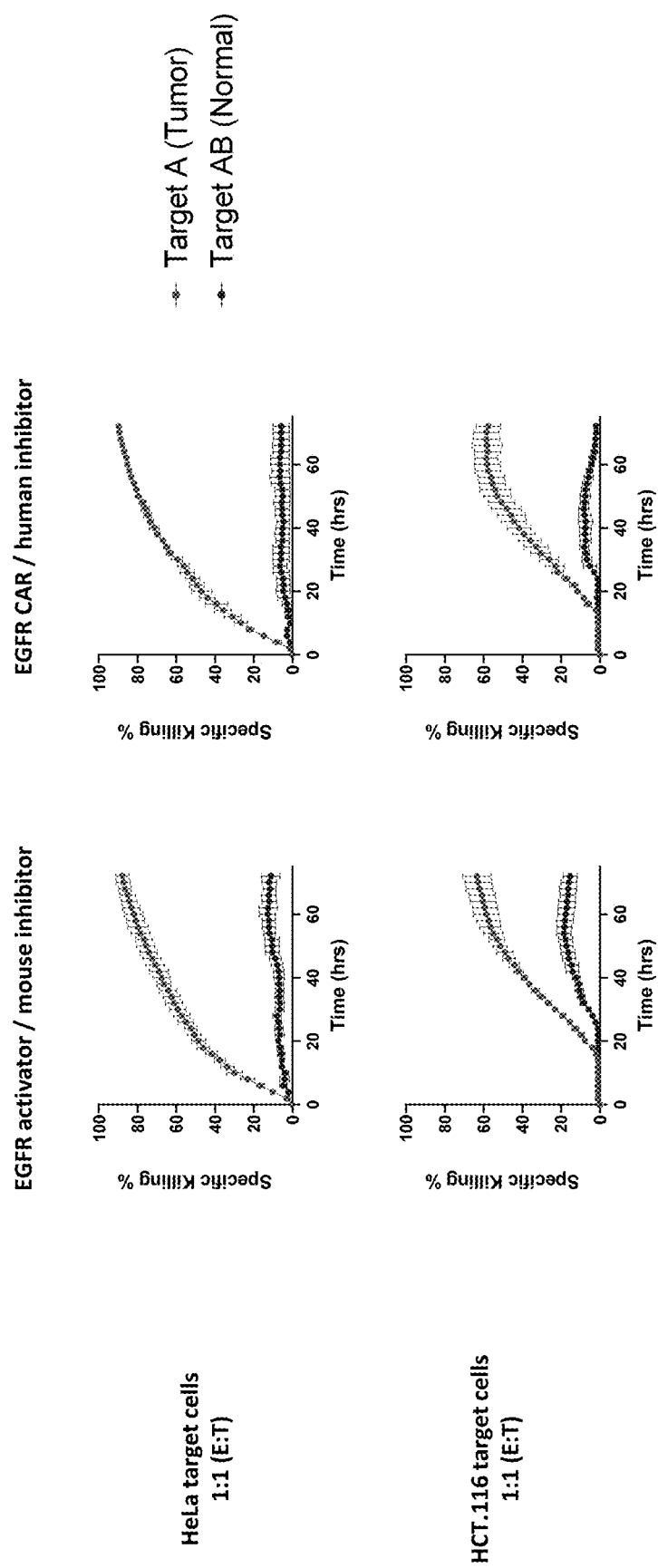
FIG. 23A is a series of plots showing the percentage of specific killing of HeLa target cells or HCT116 target cells by immune cells expressing an EGFR activator receptor and an HLA-A*02 scFv LIR1 inhibitor receptor. The target cells express the EGFR antigen (A), or both the EGFR antigen and the HLA-A*02 non-target antigen (B). Immune cells expressing the activator/inhibitor receptor pair were incubated with target cells at a 1:1 ratio.

Example 11: Characterization of Immune Cell Activation Selectivity in Primary T Cells Expressing an Activator and Inhibitory Receptor For selective cytotoxicity studies, enriched primary T cells were incubated with HeLa or HCT116 target cells that express GFP or RFP. For "tumor" cells, WT HeLa or HLA-A*02 knocked-out HCT116 were used and for "normal" cells, HLA-A*02 transduced HeLa or WT HCT116 were used. The cocultures were imaged using an IncuCyte live cell imager and target cell fluorescence area was used to quantify live target cells (FIG. 23A). For measuring selective cytotoxicity in mixed target culture, RFP expressing "tumor" WT HeLa cells and GFP expressing "normal" HeLa cells transduced with HLA-A*02 were mixed at a 1:1 ratio. Enriched primary T cells were added to the mixed target culture and imaged using an IncuCyte live cell imager and target cell fluorescence area was used to quantify live target cells (FIG. 23B).

FIG. 23A is a series of plots showing the percentage of specific killing of HeLa target cells or HCT116 target cells by immune cells expressing an EGFR activator receptor and an HLA-A*02 scFv LIR1 inhibitor receptor. The target cells express the EGFR antigen (A), the HLA-A*02 non-target antigen (B), or both (AB). Immune cells expressing the activator/inhibitor receptor pair were incubated with target cells at a 1:1 ratio.

Figure 23B:
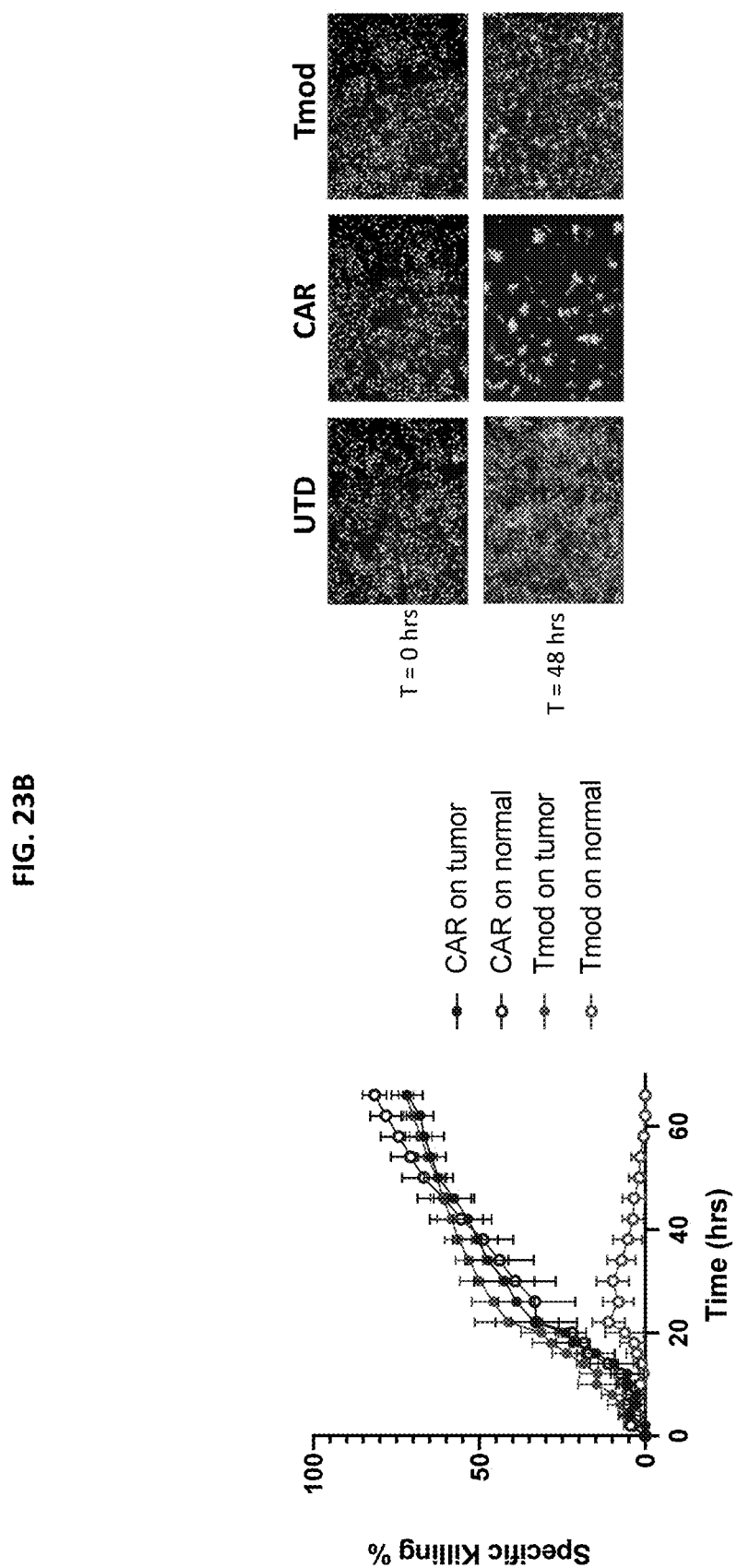
FIG. 23B is a plot and series of images showing specific and selective killing of target cells by immune cells expressing an EGFR activator receptor and an HLA-A*02 scFv LIR1 inhibitor receptor in a mixed culture of cancer cells and normal cells. UTD=immune cells no activator or inhibitor receptors; CAR=immune cells expressing only activator receptor; Tmod=immune cells expressing both activator and inhibitor receptors. In the images on the right: green=normal cells; red=tumor cells.

FIG. 23B is a plot and series of images showing specific and selective killing of target cells by immune cells expressing an EGFR activator receptor and an HLA-A*02 scFv LIR1 inhibitor receptor in a mixed culture of cancer cells and normal cells. UTD=immune cells no activator or inhibitor receptors; CAR=immune cells expressing only activator receptor; Tmod=immune cells expressing both activator and inhibitor receptors.

Figure 24:
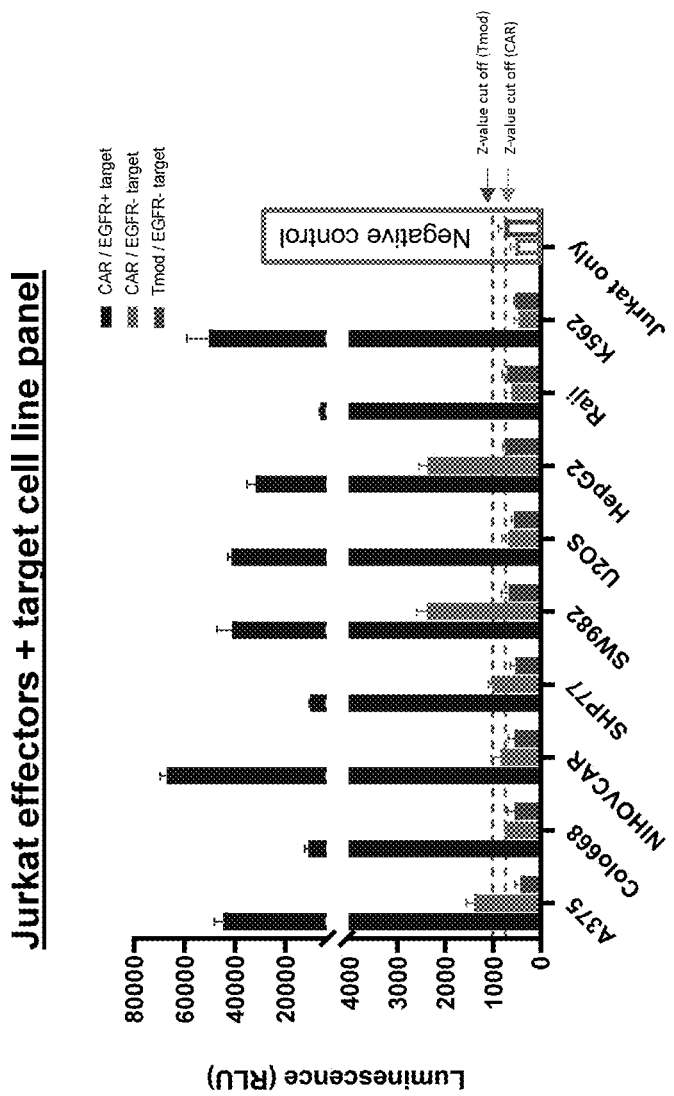
FIG. 24 is a chart showing selective cell activation in Jurkat cells (effectors) expressing EGFR activator receptor (CAR) or EGFR activator receptor and HLA-A*02 inhibitor receptor (Tmod). The Jurkat cells were incubated with a panel of target cell lines that express HLA-A*02 with or without EGFR expression. Tmod Jurkat effector cells showed no off-target activation when co-cultured with target cells that do not express EGFR or cells that express HLA-A*02.

Example 12: Characterization of Immune Cell Activation Selectivity in Jurkat Cells Expressing an Activator and Inhibitory Receptor FIG. 24 is a chart showing immune cell activation in Jurkat cells (effectors) expressing EGFR activator receptor (CAR) or EGFR activator receptor and HLA-A*02 inhibitor receptor (Tmod). The Jurkat cells were incubated with a panel of target cell lines that express HLA-A*02 either without EGFR expression or express HLA-A*02 with EGFR expression. EGFR negative cell lines were generated by knocking out EGFR using CRISPR/Cas9. Tmod Jurkat effector cells showed no off-target activation when cocultured with EGFR negative cells.

SEQUENCE LISTING (919 sequences)

SEQ ID NO: 1 - protein, 1210 aa, Homo sapiens [sequence omitted]

SEQ ID NO: 2 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 3 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 4 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 5 - protein, 1091 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 6 - protein, 1136 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 7 - protein, 1157 aa, Homo sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 8 - protein, 943 aa, Homo sapiens
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 9 - protein, 249 aa, Artificial Sequence
  CT-478 EGFR (VH-VL scFv Format)
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSGGGGSGGGGSGGGGSGGAIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIK

SEQ ID NO: 10 - protein, 249 aa, Artificial Sequence
  CT-479 EGFR (VL-VH scFv Format)
AIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIKGGGGSGGGGSGGGGSGGQVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSS

SEQ ID NO: 11 - protein, 247 aa, Artificial Sequence
  CT-480 EGFR (VH-VL scFv format)
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSSGGGGSGGGGSGGGGSGGDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 12 - protein, 247 aa, Artificial Sequence
  CT-481 EGFR (VL-VH scFv Format)
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIKGGGGSGGGGSGGGGSGGQIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 13 - protein, 249 aa, Artificial Sequence
  CT-482 EGFR (VH-VL scFv Format)
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSSGGGGSGGGGSGGGGSGGDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 14 - protein, 249 aa, Artificial Sequence
  CT-483 EGFR (VL-VH scFv Format)
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIKGGGGSGGGGSGGGGSGGEMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 15 - protein, 243 aa, Artificial Sequence
  CT-486 EGFR (VH-VL scFv Format)
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSGGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 16 - protein, 244 aa, Artificial Sequence
  CT-487 EGFR (VH-VL scFv Format)
QVQLVQSGAEVKKPGASVKVSCKASGYTFTSHWMHWVRQAPGQGLEWIGEFNPSNGRTNYNEKFKSKATMTVDTSTNTAYMELSSLRSEDTAVYYCASRDYDYDGRYFDYWGQGTLVTVSSGGGGSGGGGSGGGGSGGDIQMTQSPSSLSASVGDRVTITCSASSSVTYMYWYQQKPGKAPKLLIYDTSNLASGVPSRFSGSGSGTDYTFTISSLQPEDIATYYCQQWSSHIFTFGQGTKVEIK

SEQ ID NO: 17 - protein, 243 aa, Artificial Sequence
  CT-488 EGFR (VH-VL scFv Format)
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSGGGGSGGGGSGGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIK

SEQ ID NO: 18 - protein, 245 aa, Artificial Sequence
  CT-489 EGFR scFv
QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSGGGGSGGGGSGGGGSGGEIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIK

SEQ ID NO: 19 - protein, 125 aa, Artificial Sequence [sequence omitted]

SEQ ID NO: 20 - protein, 118 aa, Artificial Sequence
  EGFR VH CT480, CT481
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 21 - protein, 121 aa, Artificial Sequence
  EGFR VH CT482, CT483
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 22 - protein, 119 aa, Artificial Sequence
  EGFR VH CT486
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 23 - protein, 121 aa, Artificial Sequence [sequence omitted]

SEQ ID NO: 24 - protein, 119 aa, Artificial Sequence [sequence omitted]

SEQ ID NO: 25 - protein, 107 aa, Artificial Sequence [sequence omitted]

SEQ ID NO: 26 - protein, 112 aa, Artificial Sequence
  EGFR VL CT480, CT481
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 27 - protein, 111 aa, Artificial Sequence
  EGFR VL CT482, CT483
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 28 - protein, 107 aa, Artificial Sequence
  EGFR VL CT486
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 29 - protein, 106 aa, Artificial Sequence [sequence omitted]

SEQ ID NO: 30 - protein, 107 aa, Artificial Sequence [sequence omitted]

SEQ ID NO: 31 - protein, 5 aa, Artificial Sequence
  EGFR antigen binding domain CDR H1
TYGMH

SEQ ID NO: 32 - protein, 5 aa, Artificial Sequence
  EGFR antigen binding domain CDR H1
EYPIH

SEQ ID NO: 33 - protein, 5 aa, Artificial Sequence
  EGFR antigen binding domain CDR H1
HYDMS

SEQ ID NO: 34 - protein, 5 aa, Artificial Sequence
  EGFR antigen binding domain CDR H1
NYGVH

SEQ ID NO: 35 - protein, 5 aa, Artificial Sequence
  EGFR antigen binding domain CDR H1
SHWMH

SEQ ID NO: 36 - protein, 7 aa, Artificial Sequence
  EGFR antigen binding domain CDR H1
SGDYYWT

SEQ ID NO: 37 - protein, 17 aa, Artificial Sequence
  EGFR antigen binding domain CDR H2
VIWDDGSYKYYGDSVKG

SEQ ID NO: 38 - protein, 17 aa, Artificial Sequence
  EGFR antigen binding domain CDR H2
MIYTDIGKPTYAEEFKG

SEQ ID NO: 39 - protein, 17 aa, Artificial Sequence
  EGFR antigen binding domain CDR H2
YIASGGDITYYADTVKG

SEQ ID NO: 40 - protein, 16 aa, Artificial Sequence
  EGFR antigen binding domain CDR H2
VIWSGGNTDYNTPFTS

SEQ ID NO: 41 - protein, 17 aa, Artificial Sequence
  EGFR antigen binding domain CDR H2
EFNPSNGRTNYNEKFKS

SEQ ID NO: 42 - protein, 16 aa, Artificial Sequence
  EGFR antigen binding domain CDR H2
HIYYSGNTNYNPSLKS

SEQ ID NO: 43 - protein, 16 aa, Artificial Sequence
  EGFR antigen binding domain CDR H3
DGITMVRGVMKDYFDY

SEQ ID NO: 44 - protein, 9 aa, Artificial Sequence
  EGFR antigen binding domain CDR H3
DRYDSLFDY

SEQ ID NO: 45 - protein, 12 aa, Artificial Sequence
  EGFR antigen binding domain CDR H3
SSYGNNGDALDF

SEQ ID NO: 46 - protein, 11 aa, Artificial Sequence
  EGFR antigen binding domain CDR H3
ALTYYDYEFAY

SEQ ID NO: 47 - protein, 12 aa, Artificial Sequence
  EGFR antigen binding domain CDR H3
RDYDYDGRYFDY

SEQ ID NO: 48 - protein, 9 aa, Artificial Sequence
  EGFR antigen binding domain CDR H3
DRVTGAFDI

SEQ ID NO: 49 - protein, 11 aa, Artificial Sequence
  EGFR antigen binding domain CDR L1
RASQDISSALV

SEQ ID NO: 50 - protein, 16 aa, Artificial Sequence
  EGFR antigen binding domain CDR L1
RSSQSLVHSNGNTYLH

SEQ ID NO: 51 - protein, 16 aa, Artificial Sequence
  EGFR antigen binding domain CDR L1
RSSQSLVHSNGNTYLH

SEQ ID NO: 52 - protein, 11 aa, Artificial Sequence
  EGFR antigen binding domain CDR L1
RASQSIGTNIH

SEQ ID NO: 53 - protein, 10 aa, Artificial Sequence
  EGFR antigen binding domain CDR L1
SASSSVTYMY

SEQ ID NO: 54 - protein, 11 aa, Artificial Sequence
  EGFR antigen binding domain CDR L1
QASQDISNYLN

SEQ ID NO: 55 - protein, 7 aa, Artificial Sequence
  EGFR antigen binding domain CDR L2
DASSLES

SEQ ID NO: 56 - protein, 7 aa, Artificial Sequence
  EGFR antigen binding domain CDR L2
KVSNRFS

SEQ ID NO: 57 - protein, 7 aa, Artificial Sequence
  EGFR antigen binding domain CDR L2
YASESIS

SEQ ID NO: 58 - protein, 7 aa, Artificial Sequence
  EGFR antigen binding domain CDR L2
DTSNLAS

SEQ ID NO: 59 - protein, 7 aa, Artificial Sequence
  EGFR antigen binding domain CDR L2
DASNLET

SEQ ID NO: 60 - protein, 9 aa, Artificial Sequence
  EGFR antigen binding domain CDR L3
QQFNSYPLT

SEQ ID NO: 61 - protein, 9 aa, Artificial Sequence
  EGFR antigen binding domain CDR L3
SQSTHVPWT

SEQ ID NO: 62 - protein, 8 aa, Artificial Sequence
  EGFR antigen binding domain CDR L3
SQSTHVLT

SEQ ID NO: 63 - protein, 9 aa, Artificial Sequence
  EGFR antigen binding domain CDR L3
QQNNNWPTT

SEQ ID NO: 64 - protein, 9 aa, Artificial Sequence
  EGFR antigen binding domain CDR L3
QQWSSHIFT

SEQ ID NO: 65 - protein, 9 aa, Artificial Sequence
  EGFR antigen binding domain CDR L3
QHFDHLPLA

SEQ ID NO: 66 - protein, 45 aa, Unknown
  CD8alpha hinge
TTTPAPRPPTPAPTIASQPLSLRPEACRPAAGGAVHTRGLDFACD

SEQ ID NO: 67 - DNA, 135 bp, Unknown
  CD8alpha hinge
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 68 - protein, 41 aa, Unknown
  CD28 hinge
CTIEVMYPPPYLDNEKSNGTIIHVKGKHLCPSPLFPGPSKP

SEQ ID NO: 69 - DNA, 123 bp, Unknown
  CD28 hinge
tgtaccattgaagttatgtatcctcctccttacctagacaatgagaagagcaatggaaccattatccatgtgaaagggaaacacctttgtccaagtcccctatttcccggaccttctaagccc

SEQ ID NO: 70 - protein, 27 aa, Unknown
  CD28 transmembrane domain
FWVLVVVGGVLACYSLLVTVAFIIFWV

SEQ ID NO: 71 - DNA, 81 bp, Unknown
  CD28 transmembrane domain
ttctgggtgctggtcgttgtgggcggcgtgctggcctgctacagcctgctggtgacagtggccttcatcatcttttgggtg

SEQ ID NO: 72 - protein, 25 aa, Unknown
  IL-2Rbeta transmembrane domain
IPWLGHLLVGLSGAFGFIILVYLLI

SEQ ID NO: 73 - DNA, 75 bp, Unknown
  IL-2Rbeta transmembrane domain
attccgtggctcggccacctcctcgtgggcctcagcggggcttttggcttcatcatcttagtgtacttgctgatc

SEQ ID NO: 74 - protein, 112 aa, Unknown
  CD3zeta activation domain
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 75 - DNA, 336 bp, Unknown
  CD3zeta activation domain
agagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 76 - protein, 43 aa, Unknown
  CD3zeta activation domain
RVKFSRSADAPAYQQGQNQLYNELNLGRREEYDVLHMQALPPR

SEQ ID NO: 77 - DNA, 129 bp, Unknown
  CD3zeta activation domain
agagtgaagttcagcaggagcgcagacgcccccgcgtaccagcagggccagaaccagctctataacgagctcaatctaggacgaagagaggagtacgatgttttgcacatgcaggccctgccccctcgc

SEQ ID NO: 78 - protein, 41 aa, Unknown
  CD28 co-stimulatory domain
RSKRSRLLHSDYMNMTPRRPGPTRKHYQPYAPPRDFAAYRS

SEQ ID NO: 79 - DNA, 123 bp, Unknown
  CD28 co-stimulatory domain
aggagcaagcggagcagactgctgcacagcgactacatgaacatgaccccccggaggcctggccccacccggaagcactaccagccctacgcccctcccagggatttcgccgcctaccggagc

SEQ ID NO: 80 - protein, 23 aa, Unknown
  TCR alpha transmembrane domain
VIGFRILLLKVAGFNLLMTLRLW

SEQ ID NO: 81 - DNA, 69 bp, Unknown
  TCR alpha transmembrane domain
gtgattgggttccgaatcctcctcctgaaagtggccgggtttaatctgctcatgacgctgcggctgtgg

SEQ ID NO: 82 - protein, 23 aa, Unknown
  TCR beta transmembrane domain
TILYEILLGKATLYAVLVSALVL

SEQ ID NO: 83 - DNA, 69 bp, Unknown
  TCR beta transmembrane domain
accatcctctatgagatcttgctagggaaggccaccttgtatgccgtgctggtcagtgccctcgtgctg

SEQ ID NO: 84 - protein, 10 aa, Unknown
  TCR beta intracellular domain
MAMVKRKDSR

SEQ ID NO: 85 - DNA, 30 bp, Unknown
  TCR beta intracellular domain
atggccatggtcaagagaaaggattccaga

SEQ ID NO: 86 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 87 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 88 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 89 - protein, 247 aa, Artificial Sequence
  C-001765 PA2.1 scFv (mouse)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 90 - protein, 247 aa, Artificial Sequence
  C-002159 PA2.1.8 scFv (humanized)
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 91 - protein, 247 aa, Artificial Sequence
  C-002160 PA2.1.9 scFv (humanized)
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGDIVMTQTPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIK

SEQ ID NO: 92 - protein, 247 aa, Artificial Sequence
  C-002161 PA2.1.10 scFv (humanized)
EVQLVESGGGLVKPGGSLRLSCAASGYTFTSYHIHWVRQAPGKGLEWVGWIYPGNVNTEYNEKFKGRFTISRDDSKNTLYLQMNSLKTEDTAVYYCAREEITYAMDYWGQGTTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPRTFGGGTKVEIK

SEQ ID NO: 93 - protein, 247 aa, Artificial Sequence
  C-002162 PA2.1.14 scFv (humanized)
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 94 - protein, 247 aa, Artificial Sequence
  C-002163 PA2.1.18 scFv (humanized)
QVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 95 - protein, 247 aa, Artificial Sequence
  C-002164 BB7.2 scFv (mouse)
QVQLQQSGPELVKPGASVKMSCKASGYTFTSYHIQWVKQRPGQGLEWIGWIYPGDGSTQYNEKFKGKTTLTADKSSSTAYMLLSSLTSEDSAIYFCAREGTYYAMDYWGQGTSVTVSSGGGGSGGGGSGGGGSGGDVLMTQTPLSLPVSLGDQVSISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 96 - protein, 247 aa, Artificial Sequence
  C-002165 BB7.2.1 scFv (humanized)
QLQLQESGPGLVKPSETLSLTCTVSGYTFTSYHIQWIRQPPGKGLEWIGWIYPGDGSTQYNEKFKGRATISVDTSKNQFSLNLDSVSAADTAIYYCAREGTYYAMDYWGKGSTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTFTISSLQPEDIATYYCFQGSHVPRTFGPGTKVDIK

SEQ ID NO: 97 - protein, 247 aa, Artificial Sequence
  C-002166 BB7.2.2 scFv (humanized)
EVQLVQSGAELKKPGSSVKVSCKASGYTFTSYHIQWVKQAPGQGLEWIGWIYPGDGSTQYNEKFKGKATLTVDKSTNTAYMELSSLRSEDTAVYYCAREGTYYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPSRFSGSGSGTDFTLTISSLQPDDFATYYCFQGSHVPRTFGQGTKVEVK

SEQ ID NO: 98 - protein, 247 aa, Artificial Sequence
  C-002167 BB7.2.3 scFv (humanized)
QVQLVQSGAEVKKPGSSVKVSCKASGYTFTSYHIQWVRQAPGQGLEWMGWIYPGDGSTQYNEKFKGRVTITADKSTSTAYMELSSLRSEDTAVYYCAREGTYYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 99 - protein, 247 aa, Artificial Sequence
  C-002168 BB7.2.5 scFv (humanized)
QVTLKQSGAEVKKPGSSVKVSCTASGYTFTSYHVSWVRQAPGQGLEWLGRIYPGDGSTQYNEKFKGKVTITADKSMDTSFMELTSLTSEDTAVYYCAREGTYYAMDLWGQGTLVTVSSGGGGSGGGGSGGGGSGGEIVLTQSPGTLSLSPGERATLSCRSSQSIVHSNGNTYLAWYQQKPGQAPRLLISKVSNRFSGVPDRFSGSGSGTDFTLTISRLEPEDFAVYYCQQGSHVPRTFGGGTKVEIK

SEQ ID NO: 100 - protein, 247 aa, Artificial Sequence
  C-002169 BB7.2.6 scFv (humanized)
QVQLVQSGAEVKKPGASVKVSCKASGYTFTSYHMHWVRQAPGQRLEWMGWIYPGDGSTQYNEKFKGKVTITRDTSASTAYMELSSLRSEDTAVYYCAREGTYYAMDYWGQGTLVTVSSGGGGSGGGGSGGGGSGGDIVMTQTPLSLPVTPGEPASISCRSSQSIVHSNGNTYLDWYLQKPGQSPQLLIYKVSNRFSGVPDRFSGSGSGTDFTLKISRVEAEDVGVYYCMQGSHVPRTFGGGTKVEIK

SEQ ID NO: 101 - protein, 16 aa, Artificial Sequence
  HLA-A*02 CDR-L1
RSSQSIVHSNGNTYLE

SEQ ID NO: 102 - protein, 12 aa, Artificial Sequence
  HLA-A*02 CDR-L2
KVSNRFSGVPDR

SEQ ID NO: 103 - protein, 9 aa, Artificial Sequence
  HLA-A*02 CDR-L3
FQGSHVPRT

SEQ ID NO: 104 - protein, 12 aa, Artificial Sequence
  HLA-A*02 CDR-H1
ASGYTFTSYHIH

SEQ ID NO: 105 - protein, 18 aa, Artificial Sequence
  HLA-A*02 CDR-H2
WIYPGNVNTEYNEKFKGK

SEQ ID NO: 106 - protein, 9 aa, Artificial Sequence
  HLA-A*02 CDR-H3
EEITYAMDY

SEQ ID NO: 107 - protein, 16 aa, Artificial Sequence
  HLA-A*02 CDR-L1
RSSQSIVHSNGNTYLD

SEQ ID NO: 108 - protein, 12 aa, Artificial Sequence
  HLA-A*02 CDR-L2
KVSNRFSGVPDR

SEQ ID NO: 109 - protein, 9 aa, Artificial Sequence
  HLA-A*02 CDR-L3
MQGSHVPRT

SEQ ID NO: 110 - protein, 11 aa, Artificial Sequence
  HLA-A*02 CDR-H1
SGYTFTSYHMH

SEQ ID NO: 111 - protein, 17 aa, Artificial Sequence
  HLA-A*02 CDR-H2
WIYPGDGSTQYNEKFKG

SEQ ID NO: 112 - protein, 9 aa, Artificial Sequence
  HLA-A*02 CDR-H3
EGTYYAMDY

SEQ ID NO: 113 - protein, 670 aa, Unknown
  LILRB1
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHPSQEGPSPAVPSIYATLAIH

SEQ ID NO: 114 - DNA, 3229 bp, Unknown
  LILRB1
aaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaaaaaaaaaaaaaaa

SEQ ID NO: 115 - protein, 6 aa, Unknown
  immunoreceptor tyrosine-based inhibitory motif
NLYAAV

SEQ ID NO: 116 - protein, 6 aa, Unknown
  immunoreceptor tyrosine-based inhibitory motif
VTYAEV

SEQ ID NO: 117 - protein, 6 aa, Unknown
  immunoreceptor tyrosine-based inhibitory motif
VTYAQL

SEQ ID NO: 118 - protein, 6 aa, Unknown
  immunoreceptor tyrosine-based inhibitory motif
SIYATL

SEQ ID NO: 119 - protein, 35 aa, Unknown
  intracellular domain
NLYAAVKHTQPEDGVEMDTRSPHDEDPQAVTYAEV

SEQ ID NO: 120 - protein, 58 aa, Unknown
  intracellular domain
VTYAEVKHSRPRREMASPPSPLSGEFLDTKDRQAEEDRQMDTEAAASEAPQDVTYAQL

SEQ ID NO: 121 - protein, 36 aa, Unknown
  intracellular domain
VTYAQLHSLTLRREATEPPPSQEGPSPAVPSIYATL

SEQ ID NO: 122 - protein, 87 aa, Unknown
  intracellular domain
NLYAAVKHTQPEDGVEMDTRSPHDEDPQAVTYAEVKHSRPRREMASPPSPLSGEFLDTKDRQAEEDRQMDTEAAASEAPQDVTYAQL

SEQ ID NO: 123 - protein, 88 aa, Unknown
  intracellular domain
VTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 124 - protein, 117 aa, Unknown
  intracellular domain
NLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 125 - protein, 20 aa, Unknown
  LILRB1 D3D4 domain
YGSQSSKPYLLTHPSDPLEL

SEQ ID NO: 126 - protein, 43 aa, Unknown
  LILRB1 hinge domain
VVSGPSGGPSSPTTGPTSTSGPEDQPLTPTGSDPQSGLGRHLG

SEQ ID NO: 127 - protein, 86 aa, Unknown
  Hinge-transmembrane
YGSQSSKPYLLTHPSDPLELVVSGPSGGPSSPTTGPTSTSGPEDQPLTPTGSDPQSGLGRHLGVVIGILVAVILLLLLLLLLFLIL

SEQ ID NO: 128 - protein, 190 aa, Unknown
  Transmembrane-intracellular domain
VVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 129 - protein, 167 aa, Unknown
  LILRB1 intracellular domain
RHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 130 - protein, 253 aa, Unknown
  LILRB1 hinge-transmembrane-intracellular domain
YGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 131 - protein, 233 aa, Unknown
  LILRB1 hinge-transmembrane-intracellular domain
VVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 132 - protein, 63 aa, Unknown
  LILRB1 hinge domain
YGSQSSKPYLLTHPSDPLELVVSGPSGGPSSPTTGPTSTSGPEDQPLTPTGSDPQSGLGRHLG

SEQ ID NO: 133 - protein, 23 aa, Unknown
  LILRB1 transmembrane domain
VVIGILVAVILLLLLLLLLFLIL

SEQ ID NO: 134 - protein, 227 aa, Homo sapiens
  SITE (1)..(1): Xaa can be any naturally occurring amino acid
XDVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 135 - protein, 94 aa, Homo sapiens
PEDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 136 - protein, 17 aa, Artificial Sequence
  linker
GGGGSGGGGSGGGGSGG

SEQ ID NO: 137 - protein, 22 aa, Artificial Sequence
  signal sequence
MDMRVPAQLLGLLLLWLRGARC

SEQ ID NO: 138 - DNA, 66 bp, Artificial Sequence
  signal sequence
atggacatgagggtccccgctcagctcctggggctcctgctactctggctccgaggtgccagatgt

SEQ ID NO: 139 - DNA, 747 bp, Artificial Sequence
  CT-478 EGFR (VH-VL scFv Format)
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatgggatgatggaagttataaatactatggagactccgtgaagggccgattcaccatctccagagacaattccaagaacacgctgtatctgcaaatgaacagcctgagagccgaggacacggctgtgtattactgtgcgagagatggtattactatggttcggggagttatgaaggactactttgactactggggccagggaaccctggtcaccgtctcctcaggcggaggtggaagcggagggggaggatctggcggcggaggaagcggaggcgccatccagttgacccagtctccatcctccctgtctgcatctgtaggagacagagtcaccatcacttgccgggcaagtcaggacattagcagtgctttagtctggtatcagcagaaaccagggaaagctcctaagctcctgatctatgatgcctccagtttggaaagtggggtcccatcaaggttcagcggcagtgaatctgggacagatttcactctcaccatcagcagcctgcagcctgaagattttgcaacttattactgtcaacagtttaatagttacccgctcactttcggcggagggaccaaggtggagatcaaa

SEQ ID NO: 140 - DNA, 747 bp, Artificial Sequence
  CT-479 EGFR (VL-VH scFv Format)
gccatccagttgacccagtctccatcctccctgtctgcatctgtaggagacagagtcaccatcacttgccgggcaagtcaggacattagcagtgctttagtctggtatcagcagaaaccagggaaagctcctaagctcctgatctatgatgcctccagtttggaaagtggggtcccatcaaggttcagcggcagtgaatctgggacagatttcactctcaccatcagcagcctgcagcctgaagattttgcaacttattactgtcaacagtttaatagttacccgctcactttcggcggagggaccaaggtggagatcaaaggcggaggtggaagcggagggggaggatctggcggcggaggaagcggaggccaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatgggatgatggaagttataaatactatggagactccgtgaagggccgattcaccatctccagagacaattccaagaacacgctgtatctgcaaatgaacagcctgagagccgaggacacggctgtgtattactgtgcgagagatggtattactatggttcggggagttatgaaggactactttgactactggggccagggaaccctggtcaccgtctcctca

SEQ ID NO: 141 - DNA, 741 bp, Artificial Sequence
  CT-480 EGFR (VH-VL scFv format)
cagatccagttggtgcagtctggacctgagctgaagaagcctggagagacagtcaagatctcctgcaaggcctctgggtataccttcacagaatatccaatacactgggtgaagcaggctccaggaaagggtttcaagtggatgggcatgatatacaccgacattggaaagccaacatatgctgaagagttcaagggacggtttgccttctctttggagacctctgccagcactgcctatttgcagatcaacaacctcaagaatgaggacacggctacatatttctgtgtaagagatcgatatgattccctctttgactactggggccaaggcaccactctcacagtctcctcaggcggaggtggaagcggagggggaggatctggcggcggaggaagcggaggcgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaa

SEQ ID NO: 142 - DNA, 741 bp, Artificial Sequence
  CT-481 EGFR (VL-VH scFv Format)
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtggacgttcggtggaggcaccaagctggaaatcaaaggcggaggtggaagcggagggggaggatctggcggcggaggaagcggaggccagatccagttggtgcagtctggacctgagctgaagaagcctggagagacagtcaagatctcctgcaaggcctctgggtataccttcacagaatatccaatacactgggtgaagcaggctccaggaaagggtttcaagtggatgggcatgatatacaccgacattggaaagccaacatatgctgaagagttcaagggacggtttgccttctctttggagacctctgccagcactgcctatttgcagatcaacaacctcaagaatgaggacacggctacatatttctgtgtaagagatcgatatgattccctctttgactactggggccaaggcaccactctcacagtctcctca

SEQ ID NO: 143 - DNA, 747 bp, Artificial Sequence
  CT-482 EGFR (VH-VL scFv Format)
gaaatgcagctggtggagtctgggggaggcttcgtgaagcctggagggtccctgaaactctcatgtgcagcctctggattcgctttcagtcactatgacatgtcttgggttcgccagactccgaagcagaggctggagtgggtcgcatacattgctagtggtggtgatatcacctactatgcagacactgtgaagggccgattcaccatctccagagacaatgcccagaacaccctgtacctgcaaatgagcagtctgaagtctgaggacacagccatgttttactgttcacgatcctcctatggtaacaacggagatgccctggacttctggggtcaaggtacctcagtcaccgtctcctcaggcggaggtggaagcggagggggaggatctggcggcggaggaagcggaggcgatgttgtgatgacccaaactccactctccctgcctgtcagtcttggagatcaagcctccatctcttgcagatctagtcagagccttgttcacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttctcacgttcggctcggggacaaagttggaaataaaa

SEQ ID NO: 144 - DNA, 747 bp, Artificial Sequence
  CT-483 EGFR (VL-VH scFv Format)
gatgttgtgatgacccaaactccactctccctgcctgtcagtcttggagatcaagcctccatctcttgcagatctagtcagagccttgttcacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttctcacgttcggctcggggacaaagttggaaataaaaggcggaggtggaagcggagggggaggatctggcggcggaggaagcggaggcgaaatgcagctggtggagtctgggggaggcttcgtgaagcctggagggtccctgaaactctcatgtgcagcctctggattcgctttcagtcactatgacatgtcttgggttcgccagactccgaagcagaggctggagtgggtcgcatacattgctagtggtggtgatatcacctactatgcagacactgtgaagggccgattcaccatctccagagacaatgcccagaacaccctgtacctgcaaatgagcagtctgaagtctgaggacacagccatgttttactgttcacgatcctcctatggtaacaacggagatgccctggacttctggggtcaaggtacctcagtcaccgtctcctca

SEQ ID NO: 145 - DNA, 729 bp, Artificial Sequence
  CT-486 EGFR (VH-VL scFv Format)
caggtgcagctgaagcagtccggccccggcctggtgcagccctcccagtccctgtccatcacctgcaccgtgtccggcttctccctgaccaactacggcgtgcactgggtgcggcagtcccccggcaagggcctggagtggctgggcgtgatctggtccggcggcaacaccgactacaacacccccttcacctcccggctgtccatcaacaaggacaactccaagtcccaggtgttcttcaagatgaactccctgcagtccaacgacaccgccatctactactgcgcccgggccctgacctactacgactacgagttcgcctactggggccagggcaccctggtgaccgtgtccgccggcggaggtggaagcggagggggaggatctggcggcggaggaagcggaggcgacatcctgctgacccagtcccccgtgatcctgtccgtgtcccccggcgagcgggtgtccttctcctgccgggcctcccagtccatcggcaccaacatccactggtaccagcagcggaccaacggctccccccggctgctgatcaagtacgcctccgagtccatctccggcatcccctcccggttctccggctccggctccggcaccgacttcaccctgtccatcaactccgtggagtccgaggacatcgccgactactactgccagcagaacaacaactggcccaccaccttcggcgccggcaccaagctggagctgaag

SEQ ID NO: 146 - DNA, 732 bp, Artificial Sequence
  CT-487 EGFR (VH-VL scFv Format)
caggtgcagctggtgcagtccggcgccgaggtgaagaagcccggcgcctccgtgaaggtgtcctgcaaggcctccggctacaccttcacctcccactggatgcactgggtgcggcaggcccccggccagggcctggagtggatcggcgagttcaacccctccaacggccggaccaactacaacgagaagttcaagtccaaggccaccatgaccgtggacacctccaccaacaccgcctacatggagctgtcctccctgcggtccgaggacaccgccgtgtactactgcgcctcccgggactacgactacgacggccggtacttcgactactggggccagggcaccctggtgaccgtgtcctccggcggaggtggaagcggagggggaggatctggcggcggaggaagcggaggcgacatccagatgacccagtccccctcctccctgtccgcctccgtgggcgaccgggtgaccatcacctgctccgcctcctcctccgtgacctacatgtactggtaccagcagaagcccggcaaggcccccaagctgctgatctacgacacctccaacctggcctccggcgtgccctcccggttctccggctccggctccggcaccgactacaccttcaccatctcctccctgcagcccgaggacatcgccacctactactgccagcagtggtcctcccacatcttcaccttcggccagggcaccaaggtggagatcaag

SEQ ID NO: 147 - DNA, 729 bp, Artificial Sequence
  CT-488 EGFR (VH-VL scFv Format)
caggtgcagctgcaggagtccggccccggcctggtgaagccctccgagaccctgtccctgacctgcaccgtgtccggcggctccgtgtcctccggcgactactactggacctggatccggcagtcccccggcaagggcctggagtggatcggccacatctactactccggcaacaccaactacaacccctccctgaagtcccggctgaccatctccatcgacacctccaagacccagttctccctgaagctgtcctccgtgaccgccgccgacaccgccatctactactgcgtgcgggaccgggtgaccggcgccttcgacatctggggccagggcaccatggtgaccgtgtcctccggcggaggtggaagcggagggggaggatctggcggcggaggaagcggaggcgacatccagatgacccagtccccctcctccctgtccgcctccgtgggcgaccgggtgaccatcacctgccaggcctcccaggacatctccaactacctgaactggtaccagcagaagcccggcaaggcccccaagctgctgatctacgacgcctccaacctggagaccggcgtgccctcccggttctccggctccggctccggcaccgacttcaccttcaccatctcctccctgcagcccgaggacatcgccacctacttctgccagcacttcgaccacctgcccctggccttcggcggcggcaccaaggtggagatcaag

SEQ ID NO: 148 - DNA, 735 bp, Artificial Sequence
  CT-489 EGFR scFv
caggtccagctccaagagtcaggaccaggtctggtcaaaccctcacagacgctctctcttacttgcacagtatcaggcggatccattagttccggtgattattactggtcttggatccgccagcctcctggtaaggggctggagtggatcggatacatatactacagtggttccactgattataatccgtcactcaagtcccgagtaactatgtccgtggatactagcaaaaatcagttcagcctcaaagtcaattccgtaactgccgccgacaccgcggtctattattgtgcgcgggtgagcatcttcggcgtcggtacgttcgattactggggacaaggaactctcgtaacagtaagctctggcggaggtggaagcggagggggaggatctggcggcggaggaagcggaggcgagattgtaatgacccaaagccctgccactctttctctgtctccgggggaacgagcgactctgtcatgtagggcgtcccagagtgtctctagctacctcgcatggtatcagcagaaacccggacaagcccctcggctcttgatttacgatgcctcaaacagagcaacggggattccggcacggttcagcgggtctggtagcgggacagacttcacactgacgatctcttcactcgaaccagaagattttgcagtctactattgccatcagtatggttctacgccacttacatttggcgggggcaccaaggcggagataaaa

SEQ ID NO: 149 - protein, 121 aa, Artificial Sequence [sequence omitted]

SEQ ID NO: 150 - protein, 107 aa, Artificial Sequence [sequence omitted]

SEQ ID NO: 151 - protein, 7 aa, Artificial Sequence
  EGFR antigen binding domain CDR H1
SGDYYWS

SEQ ID NO: 152 - protein, 16 aa, Artificial Sequence
  EGFR antigen binding domain CDR H2
YIYYSGSTDYNPSLKS

SEQ ID NO: 153 - protein, 11 aa, Artificial Sequence
  EGFR antigen binding domain CDR H3
VSIFGVGTFDY

SEQ ID NO: 154 - protein, 11 aa, Artificial Sequence
  EGFR antigen binding domain CDR L1
RASQSVSSYLA

SEQ ID NO: 155 - protein, 7 aa, Artificial Sequence
  EGFR antigen binding domain CDR L2
DASNRAT

SEQ ID NO: 156 - protein, 9 aa, Artificial Sequence
  EGFR antigen binding domain CDR L3
HQYGSTPLT

SEQ ID NO: 157 - protein, 4 aa, Unknown
  immunoreceptor tyrosine-based activation motif
  SITE (2)..(3): Xaa is any amino acid
  SITE (4)..(4): Xaa is Leu or Ile
YXXX

SEQ ID NO: 158 - protein, 195 aa, Unknown
  CAR intracellular domain
RSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 159 - protein, 42 aa, Unknown
  4-1BB co-stimulatory domain
KRGRKKLLYIFKQPFMRPVQTTQEEDGCSCRFPEEEEGGCEL

SEQ ID NO: 160 - DNA, 126 bp, Unknown
  4-1BB co-stimulatory domain
aaacggggcagaaagaaactcctgtatatattcaaacaaccatttatgaggccagtacaaactactcaagaggaagatggctgtagctgccgatttccagaagaagaagaaggaggatgtgaactg

SEQ ID NO: 161 - DNA, 741 bp, Artificial Sequence
  C-001765 PA2.1 scFv (mouse)
gatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctca

SEQ ID NO: 162 - DNA, 741 bp, Artificial Sequence
  C-002159 PA2.1.8 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgagattgtattgacccagagcccaggcaccctgagcctctctccaggagagcgggccaccctcagttgtagatccagtcagagtattgtacacagtaatgggaacacctatttggaatggtatcagcagaaaccaggtcaagccccaagattgctcatctacaaagtctctaacagatttagtggtattccagacaggttcagcggttccggaagtggtactgatttcaccctcacgatctccaggctcgagccagaagatttcgccgtttattactgttttcaaggttcacatgtgccgcgcacattcggtgggggtactaaagtagaaatcaaa

SEQ ID NO: 163 - DNA, 741 bp, Artificial Sequence
  C-002160 PA2.1.9 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattgtaatgacccagaccccactcagcctgcccgtcactccaggagagccggccagcatcagttgtagatccagtcagagtattgtacacagtaatgggaacacctatttggaatggtatctgcagaaaccaggtcaatccccacaattgctcatctacaaagtctctaacagatttagtggtgtaccagacaggttcagcggttccggaagtggtactgatttcaccctcaagatctccagggtcgaggcagaagatgtcggcgtttattactgttttcaaggttcacatgtgccgcgcacattcggtgggggtactaaagtagaaatcaaa

SEQ ID NO: 164 - DNA, 741 bp, Artificial Sequence
  C-002161 PA2.1.10 scFv (humanized)
gaggtgcagctggtggagtctgggggtgggctggtgaagcctgggggctcactgaggctttcctgcgcggcttctggatacaccttcactagctatcatatacattgggtgcgccaggcccccggaaaagggcttgagtgggtgggatggatctaccctggcaatgttaacacagaatataatgagaagttcaagggcagattcaccattagcagggacgattccaagaacacactctacctgcagatgaacagcctgaaaactgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattcaaatgacccagagcccatccagcctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccaagcaggttcagcggttccggaagtggtactgatttcaccctcacgatctcctctctccagccagaagatttcgccacttattactgttttcaaggttcacatgtgccgcgcacattcggtgggggtactaaagtagaaatcaaa

SEQ ID NO: 165 - DNA, 741 bp, Artificial Sequence
  C-002162 PA2.1.14 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggaggtggcggctctggaggcggaggtagcggaggtggaggctctggtggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaa

SEQ ID NO: 166 - DNA, 741 bp, Artificial Sequence
  C-002163 PA2.1.18 scFv (humanized)
caggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaa

SEQ ID NO: 167 - DNA, 741 bp, Artificial Sequence
  C-002164 BB7.2 scFv (mouse)
caggtgcagctgcagcagtctgggcctgagctggtgaagcctggggcctcagtgaagatgtcctgcaaggcttctggatacaccttcactagctatcatatccagtgggtgaagcagaggcctggacaagggcttgagtggatcggatggatctaccctggcgatggtagtacacagtataatgagaagttcaagggcaaaaccacccttaccgcggacaaatcctccagcacagcctacatgttgctgagcagcctgacctctgaagactctgctatctatttctgtgcgagggaggggacctactacgctatggactactggggccagggaacctcagtcaccgtgtcctcaggcggaggtggaagcggagggggaggatctggcggcggaggaagcggaggcgatgttttgatgacccagactccactctccctgcctgtctctcttggagaccaagtctccatctcttgtagatccagtcagagtattgtacacagtaatgggaacacctatttagaatggtatctgcagaaaccaggtcagtctccaaagttgctcatctacaaagtctctaacagatttagtggtgtaccagacaggttcagcggttccggaagtggtactgatttcaccctcaagatctcgagagtggaggctgaggatctgggagtttattactgttttcaaggttcacatgtgccgcgcacattcggtggaggtactaaactggaaatcaaa

SEQ ID NO: 168 - DNA, 741 bp, Artificial Sequence
  C-002165 BB7.2.1 scFv (humanized)
cagctgcagctgcaggagtctgggcccgggctggtgaagccttcggaaacgctgagcctcacctgcacggtttctggatacaccttcaccagctatcatatccagtggatccgacagccccctggaaaagggcttgagtggatcggatggatctaccctggcgatggttcaacacagtacaatgagaagttcaagggcagagccacgattagcgtggacacatccaagaaccaattctccctgaacctggacagcgtgagtgctgcggacacggccatttattactgtgcgagagagggaacttactacgctatggactactggggcaaagggagcacggtcaccgtgtcctcaggcggaggtggaagcggagggggaggatctggcggcggaggaagcggaggcgacatccagatgacccagagcccaagctccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccttcacgattagcagcttgcagcccgaagacatcgccacgtactactgctttcagggaagtcacgtgccgcgtaccttcgggccgggcacgaaagtggatattaag

SEQ ID NO: 169 - DNA, 3217 bp, Homo sapiens
atggccgtcatggcgccccgaaccctcgtcctgctactctcgggggctctggccctgacccagacctgggcgggtgagtgcggggtcgggagggaaacggcctctgtggggagaagcaacgggcccgcctggcgggggcgcaggacccgggaagccgcgccgggaggagggtcgggcgggtctcagccactcctcgtccccaggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggtgagtgaccccggcccggggcgcaggtcacgacctctcatcccccacggacgggccaggtcgcccacagtctccgggtccgagatccgccccgaagccgcgggaccccgagacccttgccccgggagaggcccaggcgcctttacccggtttcattttcagtttaggccaaaaatccccccaggttggtcggggcggggcggggctcgggggaccgggctgaccgcggggtccgggccaggttctcacaccgtccagaggatgtatggctgcgacgtggggtcggactggcgcttcctccgcgggtaccaccagtacgcctacgacggcaaggattacatcgccctgaaagaggacctgcgctctttgaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccttcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgacagacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgatgtggaggaggaagagctcaggtggggaaggggtgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcctggagggcctgatgtgtgttgggtgttgggcggaacagtggacacagctgtgctatggggtttctttccattggatgtattgagcatgcgatgggctgtttaaagtgtgacccctcactgtgacagatacgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 170 - DNA, 6654 bp, Homo sapiens
aagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttga

SEQ ID NO: 171 - DNA, 1698 bp, Homo sapiens
cagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 172 - RNA, 943 nt, Homo sapiens
auuccugaagcugacagcauucgggccgagaugucucgcuccguggccuuagcugugcucgcgcuacucucucuuucuggccuggaggcuauccagcguacuccaaagauucagguuuacucacgucauccagcagagaauggaaagucaaauuuccugaauugcuaugugucuggguuucauccauccgacauugaaguugacuuacugaagaauggagagagaauugaaaaaguggagcauucagacuugucuuucagcaaggacuggucuuucuaucucuuguacuacacugaauucacccccacugaaaaagaugaguaugccugccgugugaaccaugugacuuugucacagcccaagauaguuaagugggaucgagacauguaagcagcaucauggagguuugaagaugccgcauuuggauuggaugaauuccaaauucugcuugcuugcuuuuuaauauugauaugcuuauacacuuacacuuuaugcacaaaauguaggguuauaauaauguuaacauggacaugaucuucuuuauaauucuacuuugagugcugucuccauguuugauguaucugagcagguugcuccacagguagcucuaggagggcuggcaacuuagagguggggagcagagaauucucuuauccaacaucaacaucuuggucagauuugaacucuucaaucucuugcacucaaagcuuguuaagauaguuaagcgugcauaaguuaacuuccaauuuacauacucugcuuagaauuugggggaaaauuuagaaauauaauugacaggauuauuggaaauuuguuauaaugaaugaaacauuuugucauauaagauucauauuuacuucuuauacauuugauaaaguaaggcaugguugugguuaaucugguuuauuuuuguuccacaaguuaaauaaaucauaaaacuuga

SEQ ID NO: 173 - protein, 522 aa, Artificial Sequence
  C1765 (anti-HLA-A*02 chimeric antigen receptor) Prot
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 174 - protein, 522 aa, Artificial Sequence
  C2162 (anti-HLA-A*02 chimeric antigen receptor) Protein
MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 175 - protein, 532 aa, Artificial Sequence
  CT486 (anti-EGFR chimeric antigen receptor) Protein
MDMRVPAQLLGLLLLWLRGARCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSGGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 176 - protein, 532 aa, Artificial Sequence
  CT488 (anti-EGFR chimeric antigen receptor) Prot
MDMRVPAQLLGLLLLWLRGARCQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSGGGGSGGGGSGGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 177 - protein, 534 aa, Artificial Sequence
  CT489 (anti-EGFR chimeric antigen receptor) Prot
MDMRVPAQLLGLLLLWLRGARCQVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSGGGGSGGGGSGGGGSGGEIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 178 - protein, 21 aa, Unknown
  T2A self-cleaving peptide
GSGEGRGSLLTCGDVEENPGP

SEQ ID NO: 179 - DNA, 46 bp, Artificial Sequence
  shRNA0089
gcactcaaagcttgttaagatcgaaatcttaacaagctttgagtgc

SEQ ID NO: 180 - DNA, 1600 bp, Artificial Sequence
  CT486 (anti-EGFR chimeric antigen receptor) DNA
atggacatgagggtccccgctcagctcctggggctcctgctactctggctccgaggtgccagatgtcaggtgcagctgaagcagtccggccccggcctggtgcagccctcccagtccctgtccatcacctgcaccgtgtccggcttctccctgaccaactacggcgtgcactgggtgcggcagtcccccggcaagggcctggagtggctgggcgtgatctggtccggcggcaacaccgactacaacacccccttcacctcccggctgtccatcaacaaggacaactccaagtcccaggtgttcttcaagatgaactccctgcagtccaacgacaccgccatctactactgcgcccgggccctgacctactacgactacgagttcgcctactggggccagggcaccctggtgaccgtgtccgccggcggaggtggaagcggagggggaggatctggcggcggaggaagcggaggcgacatcctgctgacccagtcccccgtgatcctgtccgtgtcccccggcgagcgggtgtccttctcctgccgggcctcccagtccatcggcaccaacatccactggtaccagcagcggaccaacggctccccccggctgctgatcaagtacgcctccgagtccatctccggcatcccctcccggttctccggctccggctccggcaccgacttcaccctgtccatcaactccgtggagtccgaggacatcgccgactactactgccagcagaacaacaactggcccaccaccttcggcgccggcaccaagctggagctgaagaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctagc

SEQ ID NO: 181 - DNA, 1566 bp, Artificial Sequence
  C2162 (anti-HLA-A*02 chimeric antigen receptor) DNA
atggatatgagagtgcctgcccagctgctcggactgctccttctgtggttgagaggagctcggtgccaggtgcagctggtgcagtctggggctgaggtgaagaagcctgggtcctcagtgaaggtttcctgcaaggcttctggatacaccttcactagctatcatatacattgggtgcgccaggcccccggacaagggcttgaatggattggctggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggaggtggcggctctggaggcggaggtagcggaggtggaggctctggtggcgacattcaaatgacccagagcccatccaccctgagcgcatctgtaggtgaccgggtcaccatcacttgtagatccagtcagagtattgtacacagtaatgggaacacctatttggaatggtaccagcagaagccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 182 - DNA, 1599 bp, Artificial Sequence
  CT488 (anti-EGFR chimeric antigen receptor) DNA
atggacatgagggtccccgctcagctcctggggctcctgctactctggctccgaggtgccagatgtcaggtgcagctgcaggagtccggccccggcctggtgaagccctccgagaccctgtccctgacctgcaccgtgtccggcggctccgtgtcctccggcgactactactggacctggatccggcagtcccccggcaagggcctggagtggatcggccacatctactactccggcaacaccaactacaacccctccctgaagtcccggctgaccatctccatcgacacctccaagacccagttctccctgaagctgtcctccgtgaccgccgccgacaccgccatctactactgcgtgcgggaccgggtgaccggcgccttcgacatctggggccagggcaccatggtgaccgtgtcctccggcggaggtggaagcggagggggaggatctggcggcggaggaagcggaggcgacatccagatgacccagtccccctcctccctgtccgcctccgtgggcgaccgggtgaccatcacctgccaggcctcccaggacatctccaactacctgaactggtaccagcagaagcccggcaaggcccccaagctgctgatctacgacgcctccaacctggagaccggcgtgccctcccggttctccggctccggctccggcaccgacttcaccttcaccatctcctccctgcagcccgaggacatcgccacctacttctgccagcacttcgaccacctgcccctggccttcggcggcggcaccaaggtggagatcaagaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 183 - DNA, 1569 bp, Artificial Sequence
  C1765 (anti-HLA-A*02 chimeric antigen receptor) DNA
atggacatgagggtccccgctcagctcctggggctcctgctactctggctccgaggtgccagatgtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagtagagtggaggctgaggatctgggagtttattactgctttcaaggttcacatgttcctcggacgtccggtggaggcaccaagctggaaatcaaaggcggaggtggaagcggagggggaggatctggcggcggaggaagcggaggccaggtccagctgcagcagtctggacctgagctggtgaagcctggggcttcagtgaggatatcctgcaaggcttctggctacaccttcacaagttaccatatacattgggtgaagcagaggcctggacagggacttgagtggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggactactggggtcaaggaacctcagtcaccgtgtcctcatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 184 - DNA, 1605 bp, Artificial Sequence
  CT489 (anti-EGFR chimeric antigen receptor) DNA
atggacatgagggtccccgctcagctcctggggctcctgctactctggctccgaggtgccagatgtcaggtccagctccaagagtcaggaccaggtctggtcaaaccctcacagacgctctctcttacttgcacagtatcaggcggatccattagttccggtgattattactggtcttggatccgccagcctcctggtaaggggctggagtggatcggatacatatactacagtggttccactgattataatccgtcactcaagtcccgagtaactatgtccgtggatactagcaaaaatcagttcagcctcaaagtcaattccgtaactgccgccgacaccgcggtctattattgtgcgcgggtgagcatcttcggcgtcggtacgttcgattactggggacaaggaactctcgtaacagtaagctctggcggaggtggaagcggagggggaggatctggcggcggaggaagcggaggcgagattgtaatgacccaaagccctgccactctttctctgtctccgggggaacgagcgactctgtcatgtagggcgtcccagagtgtctctagctacctcgcatggtatcagcagaaacccggacaagcccctcggctcttgatttacgatgcctcaaacagagcaacggggattccggcacggttcagcgggtctggtagcgggacagacttcacactgacgatctcttcactcgaaccagaagattttgcagtctactattgccatcagtatggttctacgccacttacatttggcgggggcaccaaggcggagataaaaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 185 - DNA, 3234 bp, Artificial Sequence
  C2162-T2A-CT489 DNA
atggatatgagagtgcctgcccagctgctcggactgctccttctgtggttgagaggagctcggtgccaggtgcagctggtgcagtctggggctgaggtgaagaagcctgggtcctcagtgaaggtttcctgcaaggcttctggatacaccttcactagctatcatatacattgggtgcgccaggcccccggacaagggcttgaatggattggctggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggaggtggcggctctggaggcggaggtagcggaggtggaggctctggtggcgacattcaaatgacccagagcccatccaccctgagcgcatctgtaggtgaccgggtcaccatcacttgtagatccagtcagagtattgtacacagtaatgggaacacctatttggaatggtaccagcagaagccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtccagctccaagagtcaggaccaggtctggtcaaaccctcacagacgctctctcttacttgcacagtatcaggcggatccattagttccggtgattattactggtcttggatccgccagcctcctggtaaggggctggagtggatcggatacatatactacagtggttccactgattataatccgtcactcaagtcccgagtaactatgtccgtggatactagcaaaaatcagttcagcctcaaagtcaattccgtaactgccgccgacaccgcggtctattattgtgcgcgggtgagcatcttcggcgtcggtacgttcgattactggggacaaggaactctcgtaacagtaagctctggcggaggtggaagcggagggggaggatctggcggcggaggaagcggaggcgagattgtaatgacccaaagccctgccactctttctctgtctccgggggaacgagcgactctgtcatgtagggcgtcccagagtgtctctagctacctcgcatggtatcagcagaaacccggacaagcccctcggctcttgatttacgatgcctcaaacagagcaacggggattccggcacggttcagcgggtctggtagcgggacagacttcacactgacgatctcttcactcgaaccagaagattttgcagtctactattgccatcagtatggttctacgccacttacatttggcgggggcaccaaggcggagataaaaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 186 - protein, 1077 aa, Artificial Sequence
  C2162-T2A-CT489 Prot
MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSGGGGSGGGGSGGGGSGGEIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 187 - DNA, 3234 bp, Artificial Sequence
  C1765-T2A-CT489 DNA
atggatatgagagtgcctgcccagctgctcggactgctccttctgtggttgagaggagctcggtgcgatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctcatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtccagctccaagagtcaggaccaggtctggtcaaaccctcacagacgctctctcttacttgcacagtatcaggcggatccattagttccggtgattattactggtcttggatccgccagcctcctggtaaggggctggagtggatcggatacatatactacagtggttccactgattataatccgtcactcaagtcccgagtaactatgtccgtggatactagcaaaaatcagttcagcctcaaagtcaattccgtaactgccgccgacaccgcggtctattattgtgcgcgggtgagcatcttcggcgtcggtacgttcgattactggggacaaggaactctcgtaacagtaagctctggcggaggtggaagcggagggggaggatctggcggcggaggaagcggaggcgagattgtaatgacccaaagccctgccactctttctctgtctccgggggaacgagcgactctgtcatgtagggcgtcccagagtgtctctagctacctcgcatggtatcagcagaaacccggacaagcccctcggctcttgatttacgatgcctcaaacagagcaacggggattccggcacggttcagcgggtctggtagcgggacagacttcacactgacgatctcttcactcgaaccagaagattttgcagtctactattgccatcagtatggttctacgccacttacatttggcgggggcaccaaggcggagataaaaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctaa

SEQ ID NO: 188 - protein, 1077 aa, Artificial Sequence
  C1765-T2A-CT489 Prot
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSGGGGSGGGGSGGGGSGGEIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 189 - DNA, 3228 bp, Artificial Sequence
  C1765-T2A-CT486 DNA
atggatatgagagtgcctgcccagctgctcggactgctccttctgtggttgagaggagctcggtgcgatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctcatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtgcagctgaagcagtccggccccggcctggtgcagccctcccagtccctgtccatcacctgcaccgtgtccggcttctccctgaccaactacggcgtgcactgggtgcggcagtcccccggcaagggcctggagtggctgggcgtgatctggtccggcggcaacaccgactacaacacccccttcacctcccggctgtccatcaacaaggacaactccaagtcccaggtgttcttcaagatgaactccctgcagtccaacgacaccgccatctactactgcgcccgggccctgacctactacgactacgagttcgcctactggggccagggcaccctggtgaccgtgtccgccggcggaggtggaagcggagggggaggatctggcggcggaggaagcggaggcgacatcctgctgacccagtcccccgtgatcctgtccgtgtcccccggcgagcgggtgtccttctcctgccgggcctcccagtccatcggcaccaacatccactggtaccagcagcggaccaacggctccccccggctgctgatcaagtacgcctccgagtccatctccggcatcccctcccggttctccggctccggctccggcaccgacttcaccctgtccatcaactccgtggagtccgaggacatcgccgactactactgccagcagaacaacaactggcccaccaccttcggcgccggcaccaagctggagctgaagaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctaa

SEQ ID NO: 190 - protein, 1075 aa, Artificial Sequence
  C1765-T2A-CT486 Prot
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSGGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 191 - DNA, 3228 bp, Artificial Sequence
  C2162-T2A-CT486 DNA
atggatatgagagtgcctgcccagctgctcggactgctccttctgtggttgagaggagctcggtgccaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggaggtggcggctctggaggcggaggtagcggaggtggaggctctggtggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtgcagctgaagcagtccggccccggcctggtgcagccctcccagtccctgtccatcacctgcaccgtgtccggcttctccctgaccaactacggcgtgcactgggtgcggcagtcccccggcaagggcctggagtggctgggcgtgatctggtccggcggcaacaccgactacaacacccccttcacctcccggctgtccatcaacaaggacaactccaagtcccaggtgttcttcaagatgaactccctgcagtccaacgacaccgccatctactactgcgcccgggccctgacctactacgactacgagttcgcctactggggccagggcaccctggtgaccgtgtccgccggcggaggtggaagcggagggggaggatctggcggcggaggaagcggaggcgacatcctgctgacccagtcccccgtgatcctgtccgtgtcccccggcgagcgggtgtccttctcctgccgggcctcccagtccatcggcaccaacatccactggtaccagcagcggaccaacggctccccccggctgctgatcaagtacgcctccgagtccatctccggcatcccctcccggttctccggctccggctccggcaccgacttcaccctgtccatcaactccgtggagtccgaggacatcgccgactactactgccagcagaacaacaactggcccaccaccttcggcgccggcaccaagctggagctgaagaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 192 - protein, 1075 aa, Artificial Sequence
  C2162-T2A-CT486 Prot
MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSGGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - DNA, 3228 bp, Artificial Sequence
  C1765-T2A-CT488 DNA
atggatatgagagtgcctgcccagctgctcggactgctccttctgtggttgagaggagctcggtgcgatgttctgatgacccaaactccactctccctgcctgtcagtcttggagatcaagcctccatctcttgcagatctagtcagagcattgtacatagtaatggaaacacctatttagaatggtacctgcagaagccaggccagtctccaaagctgctcatctacaaagtttccaaccgattttctggggtcccagacagatttagcggatctggctctgggaccgatttcacactcaagatcagtagagtggaggctgaggatctgggagtttattactgctttcaaggttcacatgttcctcggacgtccggtggaggcacaaagctggaaatcaagggaggtggcggctctggaggcggaggtagcggaggtggaggctctggtggccaggtccagctgcagcagtctggacctgagctggtgaagccaggggcttcagtgaggatatcctgtaaggcctctggctacacctttacaagttaccatatacattgggtgaagcagaggcctggacagggactcgaatggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggattattggggtcaaggaacctcagtcaccgtgtcctcatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccacggatccggagagggcagaggcagcctgctgacatgtggcgacgtggaagagaaccctggccccatggacatgagggtccccgctcagctcctggggctcctgctactctggctccgaggtgccagatgtcaggtgcagctgcaggagtccggccccggcctggtgaagccctccgagaccctgtccctgacctgcaccgtgtccggcggctccgtgtcctccggcgactactactggacctggatccggcagtcccccggcaagggcctggagtggatcggccacatctactactccggcaacaccaactacaacccctccctgaagtcccggctgaccatctccatcgacacctccaagacccagttctccctgaagctgtcctccgtgaccgccgccgacaccgccatctactactgcgtgcgggaccgggtgaccggcgccttcgacatctggggccagggcaccatggtgaccgtgtcctccggcggaggtggaagcggagggggaggatctggcggcggaggaagcggaggcgacatccagatgacccagtccccctcctccctgtccgcctccgtgggcgaccgggtgaccatcacctgccaggcctcccaggacatctccaactacctgaactggtaccagcagaagcccggcaaggcccccaagctgctgatctacgacgcctccaacctggagaccggcgtgccctcccggttctccggctccggctccggcaccgacttcaccttcaccatctcctccctgcagcccgaggacatcgccacctacttctgccagcacttcgaccacctgcccctggccttcggcggcggcaccaaggtggagatcaagaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgaggccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctaa

SEQ ID NO: 194 - protein, 1075 aa, Artificial Sequence
  C1765-T2A-CT488 Prot
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHGSGEGRGSLLTCGDVEENPGPMDMRVPAQLLGLLLLWLRGARCQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSGGGGSGGGGSGGDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 195 - DNA, 741 bp, Artificial Sequence
  C-002166 BB7.2.2 scFv (humanized)
gaggtgcagctggtgcagtctggggccgagctgaagaagcctgggtcctcggtgaaggtgtcctgcaaggcttctggatacaccttcaccagctatcatatccagtgggtaaaacaggcccctggacaagggcttgagtggatcggatggatctaccctggcgatggttcaacacagtacaatgagaagttcaagggcaaagccacgcttaccgtggacaaatccacgaacacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatccagatgacccagagcccatccaccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccctcacgattagcagcttgcagcccgatgacttcgccacgtactactgctttcagggaagtcacgtgccgcgtaccttcgggcagggcacgaaagtggaagttaag

SEQ ID NO: 196 - DNA, 741 bp, Artificial Sequence
  C-002167 BB7.2.3 scFv (humanized)
caggtgcagctggtgcagtctggggccgaggtgaagaagcctgggtcctcggtgaaggtgtcctgcaaggcttctggatacaccttcaccagctatcatatccagtgggtacgacaggcccctggacaagggcttgagtggatgggatggatctaccctggcgatggttcaacacagtacaatgagaagttcaagggcagagtcacgattaccgcggacaaatccacgagcacagcctacatggagctgagcagcctgagatctgaggacacggccgtatattactgtgcgagagagggaacttactacgctatggactactggggccaagggaccacggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgagtggtaccagcagaagcccgggcaggccccgcgactgctcatctacaaggtgagcaaccggttctccggcatccccgaccgcttctcagggtccggctcggggacggatttcaccctcacgattagccgcttggagcccgaagacttcgccgtgtactactgctttcagggaagtcacgtgccgcgtaccttcggggggggcacgaaagtggaaattaag

SEQ ID NO: 197 - DNA, 741 bp, Artificial Sequence
  C-002168 BB7.2.5 scFv (humanized)
caggtgaccctgaagcagtctggggccgaggtgaagaagcctgggtcctcggtgaaggtgtcctgcacggcttctggatacaccttcaccagctatcatgtcagctgggtacgacaggcccctggacaagggcttgagtggttgggaaggatctaccctggcgatggttcaacacagtacaatgagaagttcaagggcaaagtcacgattaccgcggacaaatccatggacacatccttcatggagctgaccagcctgacatctgaggacacggccgtatattactgtgcgagagagggaacttactacgctatggacctctggggccaagggaccctggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgcgtggtaccagcagaagcccgggcaggccccgcgactgctcatctccaaggtgagcaaccggttctccggcgtccccgaccgcttctcagggtccggctcggggacggatttcaccctcacgattagccgcttggagcccgaagacttcgccgtgtactactgccaacagggaagtcacgtgccgcgtaccttcggggggggcacgaaagtggaaattaag

SEQ ID NO: 198 - DNA, 741 bp, Artificial Sequence
  C-002169 BB7.2.6 scFv (humanized)
caggtgcagctggtgcagtctggggccgaggtgaagaagcctggggcctcggtgaaggtgtcctgcaaggcttctggatacaccttcaccagctatcatatgcactgggtacgacaggcccctggacaaaggcttgagtggatgggatggatctaccctggcgatggttcaacacagtacaatgagaagttcaagggcaaagtcacgattacccgggacacatccgcgagcacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatcgtcatgacccagaccccactgtccctgcctgtgaccccgggcgagcccgcgagcatcagttgcagatcctctcagtccatcgtgcactccaacggcaacacgtacctcgactggtacctgcagaagcccgggcagtccccgcaactgctcatctacaaggtgagcaaccggttctccggcgtccccgaccgcttctcagggtccggctcggggacggatttcaccctcaagattagccgcgtggaggccgaagacgtcggcgtgtactactgcatgcagggaagtcacgtgccgcgtaccttcggggggggcacgaaagtggaaattaag

SEQ ID NO: 199 - protein, 244 aa, Artificial Sequence
  HLA-B*07 antigen binding domain BB7.1.10_scFv
QVQLQESGPGLVKPSQTLSLTCTVSGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 200 - protein, 244 aa, Artificial Sequence
  HLA-B*07 antigen binding domain BB7.1.9_scFv
EVQLVESGGGLVKPGGSLRLSCAASGYSITSGYSWHWVRQAPGKGLEWVSYIHFSGSTHYHPSLKSRFTISRDNAKNSLYLQMNSLRAEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 201 - protein, 244 aa, Artificial Sequence
  HLA-B*07 antigen binding domain BB7.1.8_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISSLEPEDFAVYYCQHFWVTPYTFGGGTKVEIK

SEQ ID NO: 202 - protein, 244 aa, Artificial Sequence
  HLA-B*07 antigen binding domain BB7.1.7_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISRLEPEDFAVYYCQHFWVTPYTFGGGTKVEIK

SEQ ID NO: 203 - protein, 244 aa, Artificial Sequence
  HLA-B*07 antigen binding domain BB7.1.6_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 204 - protein, 244 aa, Artificial Sequence
  HLA-B*07 antigen binding domain BB7.1.5_scFv
EVQLVESGGGLVQPGGSLRLSCAASGYSITSGYSWHWVRQAPGKGLEWVSYIHFSGSTHYHPSLKSRFTISRDNSKNTLYLQMNSLRAEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 205 - protein, 244 aa, Artificial Sequence
  HLA-B*07 antigen binding domain BB7.1.4_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 206 - protein, 244 aa, Artificial Sequence
  HLA-B*07 antigen binding domain BB7.1.3_scFv
QVQLQQWGAGLLKPSETLSLTCAVYGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 207 - protein, 244 aa, Artificial Sequence
  HLA-B*07 antigen binding domain BB7.1.2_scFv
QVQLQESGPGLVKPSQTLSLTCTVSGYSITSGYSWHWIRQHPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 208 - protein, 244 aa, Artificial Sequence
  HLA-B*07 antigen binding domain BB7.1.1_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 209 - protein, 243 aa, Artificial Sequence
  HLA-A*11 antigen binding domain 9
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYSMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 210 - protein, 244 aa, Artificial Sequence
  HLA-A*11 antigen binding domain 8
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 211 - protein, 245 aa, Artificial Sequence
  HLA-A*11 antigen binding domain 7
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 212 - protein, 243 aa, Artificial Sequence
  HLA-A*11 antigen binding domain 6
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLPGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 213 - protein, 243 aa, Artificial Sequence
  HLA-A*11 antigen binding domain 5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYLDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 214 - protein, 243 aa, Artificial Sequence
  HLA-A*11 antigen binding domain 4
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 215 - protein, 242 aa, Artificial Sequence
  HLA-A*11 antigen binding domain 3
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 216 - protein, 243 aa, Artificial Sequence
  HLA-A*11 antigen binding domain 2
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHKTTSFYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 217 - protein, 243 aa, Artificial Sequence
  HLA-A*11 antigen binding domain 1
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 218 - protein, 240 aa, Artificial Sequence
  HLA-C*07 antigen binding domain C7-45
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAVSFDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 219 - protein, 248 aa, Artificial Sequence
  HLA-C*07 antigen binding domain C7-44
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARERSISPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 220 - protein, 247 aa, Artificial Sequence
  HLA-C*07 antigen binding domain C7-43
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDSVIWYWFDPWGQGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 221 - protein, 249 aa, Artificial Sequence
  HLA-C*07 antigen binding domain C7-42
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEILPRLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 222 - protein, 245 aa, Artificial Sequence
  HLA-C*07 antigen binding domain C7-41
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGGRAHSSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 223 - protein, 251 aa, Artificial Sequence
  HLA-C*07 antigen binding domain C7-40
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 224 - protein, 246 aa, Artificial Sequence
  HLA-C*07 antigen binding domain C7-39
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTVIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 225 - protein, 250 aa, Artificial Sequence
  HLA-C*07 antigen binding domain C7-38
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDVIVEVFLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 226 - protein, 246 aa, Artificial Sequence
  HLA-C*07 antigen binding domain C7-37
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 227 - protein, 247 aa, Artificial Sequence
  HLA-C*07 antigen binding domain C7-36
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDGTFYSYSPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 228 - protein, 251 aa, Artificial Sequence
  HLA-C*07 antigen binding domain C7-35
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREWIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 229 - protein, 246 aa, Artificial Sequence
  HLA-C*07 antigen binding domain C7-34
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRSLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 230 - protein, 248 aa, Artificial Sequence
  HLA-C*07 antigen binding domain C7-33
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILAPNYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 231 - protein, 250 aa, Artificial Sequence
  HLA-C*07 antigen binding domain C7-32
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKSWKYFYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 232 - protein, 249 aa, Artificial Sequence
  HLA-C*07 antigen binding domain C7-31
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARENTSTIPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 233 - protein, 253 aa, Artificial Sequence
  HLA-C*07 antigen binding domain C7-30
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREDVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 234 - protein, 250 aa, Artificial Sequence
  HLA-C*07 antigen binding domain C7-29
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGGDIVSSSAIYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 235 - protein, 248 aa, Artificial Sequence
  HLA-C*07 antigen binding domain C7-28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLILPPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 236 - protein, 253 aa, Artificial Sequence
  HLA-C*07 antigen binding domain C7-27
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARETWIKILPRYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 237 - protein, 246 aa, Artificial Sequence
  HLA-C*07 antigen binding domain C7-26
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLSRYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 238 - protein, 242 aa, Artificial Sequence
  HLA-C*07 antigen binding domain C7-25
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREHIVLCFDYWGQGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 239 - protein, 249 aa, Artificial Sequence
  HLA-C*07 antigen binding domain C7-24
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILPRPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 240 - protein, 244 aa, Artificial Sequence
  HLA-C*07 antigen binding domain C7-23
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGSNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 241 - protein, 242 aa, Artificial Sequence
  HLA-C*07 antigen binding domain C7-22
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGTSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 242 - protein, 248 aa, Artificial Sequence
  HLA-C*07 antigen binding domain C7-21
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 243 - protein, 241 aa, Artificial Sequence
  HLA-C*07 antigen binding domain C7-20
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 244 - protein, 247 aa, Artificial Sequence
  HLA-C*07 antigen binding domain C7-19
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAWSTNILLSYTKAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 245 - protein, 246 aa, Artificial Sequence
  HLA-C*07 antigen binding domain C7-18
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKTYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 246 - protein, 253 aa, Artificial Sequence
  HLA-C*07 antigen binding domain C7-17
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDKYFHDYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 247 - protein, 246 aa, Artificial Sequence
  HLA-C*07 antigen binding domain C7-16
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTSVYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 248 - protein, 248 aa, Artificial Sequence
  HLA-C*07 antigen binding domain C7-15
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKILPYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 249 - protein, 257 aa, Artificial Sequence
  HLA-C*07 antigen binding domain C7-14
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAIQWIYIYINPRGFIFLHDAFDIWGQGTMVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 250 - protein, 248 aa, Artificial Sequence
  HLA-C*07 antigen binding domain C7-13
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAKEDVDFHHDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 251 - protein, 253 aa, Artificial Sequence
  HLA-C*07 antigen binding domain C7-12
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREGVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 252 - protein, 241 aa, Artificial Sequence
  HLA-C*07 antigen binding domain C7-11
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDRRGYFDLWGRGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 253 - protein, 248 aa, Artificial Sequence
  HLA-C*07 antigen binding domain C7-10
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATGIHVDIRSMEDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 254 - protein, 246 aa, Artificial Sequence
  HLA-C*07 antigen binding domain C7-9
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIGTSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 255 - protein, 249 aa, Artificial Sequence
  HLA-C*07 antigen binding domain C7-8
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREVVEVFLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 256 - protein, 246 aa, Artificial Sequence
  HLA-C*07 antigen binding domain C7-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 257 - protein, 256 aa, Artificial Sequence
  HLA-C*07 antigen binding domain C7-6
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGSIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 258 - protein, 248 aa, Artificial Sequence
  HLA-C*07 antigen binding domain C7-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 259 - protein, 250 aa, Artificial Sequence
  HLA-C*07 antigen binding domain C7-4
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDWLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 260 - protein, 250 aa, Artificial Sequence
  HLA-C*07 antigen binding domain C7-3
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLVDKNTSYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 261 - protein, 244 aa, Artificial Sequence
  HLA-C*07 antigen binding domain C7-2
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVQNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 262 - protein, 239 aa, Artificial Sequence
  HLA-C*07 antigen binding domain C7-1
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCATANWFDPWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 263 - protein, 244 aa, Artificial Sequence
  HLA-A*03 scFv 15
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARERVSQRGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 264 - protein, 243 aa, Artificial Sequence
  HLA-A*03 scFv 16
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARGNPDKDPFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 265 - protein, 245 aa, Artificial Sequence
  HLA-A*03 scFv 17
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDFYCTNWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 266 - protein, 244 aa, Artificial Sequence
  HLA-A*03 scFv 18
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARESSSGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 267 - protein, 250 aa, Artificial Sequence
  HLA-A*03 scFv 19
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDSGYKYNLYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 268 - protein, 249 aa, Artificial Sequence
  HLA-A*03 scFv 20
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 269 - protein, 246 aa, Artificial Sequence
  HLA-A*03 scFv 21
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARENRRYNSCYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 270 - protein, 249 aa, Artificial Sequence
  HLA-A*03 scFv 22
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYLDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 271 - protein, 245 aa, Artificial Sequence
  HLA-A*03 scFv 23
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARATLLSLSYDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 272 - protein, 248 aa, Artificial Sequence
  HLA-A*03 scFv 24
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 273 - protein, 241 aa, Artificial Sequence
  HLA-A*03 scFv 25
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARERDRWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 274 - protein, 247 aa, Artificial Sequence
  HLA-A*03 scFv 26
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARETPPSLGAFDIWGQGTMVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 275 - protein, 251 aa, Artificial Sequence
  HLA-A*03 scFv 27
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAREAYCLSDSYWYFDLWGRGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 276 - protein, 248 aa, Artificial Sequence
  HLA-A*03 scFv 28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 277 - protein, 248 aa, Artificial Sequence
  HLA-A*01 scFv A1-9
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGWTAWYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 278 - protein, 244 aa, Artificial Sequence
  HLA-A*01 scFv A1-8
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARAKYYYMDVWGKGTTVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 279 - protein, 248 aa, Artificial Sequence
  HLA-A*01 scFv A1-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDQVDKNTYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 280 - protein, 243 aa, Artificial Sequence
  HLA-A*01 scFv A1-6
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARACQLAEYFQHWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 281 - protein, 248 aa, Artificial Sequence
  HLA-A*01 scFv A1-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRVDKNTSYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 282 - protein, 245 aa, Artificial Sequence
  HLA-A*01 scFv A1-4
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRVQLKLVHWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 283 - protein, 245 aa, Artificial Sequence
  HLA-A*01 scFv A1-3
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCATYYDYVTVFYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 284 - protein, 245 aa, Artificial Sequence
  HLA-A*01 scFv A1-2
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARESYPSFYAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 285 - protein, 249 aa, Artificial Sequence
  HLA-A*01 scFv A1-1
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSNMWSYSLNDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 286 - protein, 11 aa, Artificial Sequence
  CDR-L1
RASQSISSYLN

SEQ ID NO: 287 - protein, 14 aa, Artificial Sequence
  CDR-L1
ASSTGAVTSGYYPN

SEQ ID NO: 288 - protein, 14 aa, Artificial Sequence
  CDR-L1
TGTSSDVGGYNYVS

SEQ ID NO: 289 - protein, 13 aa, Artificial Sequence
  CDR-L1
SGSSSNIGSNTVN

SEQ ID NO: 290 - protein, 11 aa, Artificial Sequence
  CDR-L1
RASENIYSNLA

SEQ ID NO: 291 - protein, 11 aa, Artificial Sequence
  CDR-L1
RASQGISSALA

SEQ ID NO: 292 - protein, 11 aa, Artificial Sequence
  CDR-L1
RASQGISSWLA

SEQ ID NO: 293 - protein, 7 aa, Artificial Sequence
  CDR-L2
AASSLQS

SEQ ID NO: 294 - protein, 7 aa, Artificial Sequence
  CDR-L2
STSNKHS

SEQ ID NO: 295 - protein, 7 aa, Artificial Sequence
  CDR-L2
EVSKRPS

SEQ ID NO: 296 - protein, 7 aa, Artificial Sequence
  CDR-L2
SNNQRPS

SEQ ID NO: 297 - protein, 7 aa, Artificial Sequence
  CDR-L2
AATYLPD

SEQ ID NO: 298 - protein, 9 aa, Artificial Sequence
  CDR-L3
QQSYSTPLT

SEQ ID NO: 299 - protein, 10 aa, Artificial Sequence
  CDR-L3
LLYYGGAQWV

SEQ ID NO: 300 - protein, 10 aa, Artificial Sequence
  CDR-L3
SSYAGSNNWV

SEQ ID NO: 301 - protein, 11 aa, Artificial Sequence
  CDR-L3
AAWDDSLNGWV

SEQ ID NO: 302 - protein, 9 aa, Artificial Sequence
  CDR-L3
QHFWVTPYT

SEQ ID NO: 303 - protein, 9 aa, Artificial Sequence
  CDR-L3
QQYNSYPLT

SEQ ID NO: 304 - protein, 9 aa, Artificial Sequence
  CDR-L3
QQANSFPLT

SEQ ID NO: 305 - protein, 5 aa, Artificial Sequence
  CDR-H1
SYGIS

SEQ ID NO: 306 - protein, 5 aa, Artificial Sequence
  CDR-H1
SYSMN

SEQ ID NO: 307 - protein, 7 aa, Artificial Sequence
  CDR-H1
SGSYYWS

SEQ ID NO: 308 - protein, 5 aa, Artificial Sequence
  CDR-H1
SYYWS

SEQ ID NO: 309 - protein, 5 aa, Artificial Sequence
  CDR-H1
SYWIG

SEQ ID NO: 310 - protein, 5 aa, Artificial Sequence
  CDR-H1
SNYMS

SEQ ID NO: 311 - protein, 7 aa, Artificial Sequence
  CDR-H1
SSSYYWG

SEQ ID NO: 312 - protein, 7 aa, Artificial Sequence
  CDR-H1
SGGYYWS

SEQ ID NO: 313 - protein, 6 aa, Artificial Sequence
  CDR-H1
SGYSWH

SEQ ID NO: 314 - protein, 7 aa, Artificial Sequence
  CDR-H1
TSGVGVG

SEQ ID NO: 315 - protein, 5 aa, Artificial Sequence
  CDR-H1
SYWMH

SEQ ID NO: 316 - protein, 5 aa, Artificial Sequence
  CDR-H1
SYDMH

SEQ ID NO: 317 - protein, 5 aa, Artificial Sequence
  CDR-H1
SYAMH

SEQ ID NO: 318 - protein, 5 aa, Artificial Sequence
  CDR-H1
SYAMS

SEQ ID NO: 319 - protein, 5 aa, Artificial Sequence
  CDR-H1
SYAMN

SEQ ID NO: 320 - protein, 5 aa, Artificial Sequence
  CDR-H1
DYYMS

SEQ ID NO: 321 - protein, 7 aa, Artificial Sequence
  CDR-H1
SNSAAWN

SEQ ID NO: 322 - protein, 5 aa, Artificial Sequence
  CDR-H1
DYYMH

SEQ ID NO: 323 - protein, 6 aa, Artificial Sequence
  CDR-H1
SSNWWG

SEQ ID NO: 324 - protein, 5 aa, Artificial Sequence
  CDR-H1
SYDIN

SEQ ID NO: 325 - protein, 7 aa, Artificial Sequence
  CDR-H1
SGGYSWS

SEQ ID NO: 326 - protein, 17 aa, Artificial Sequence
  CDR-H2
WISAYNGNTNYAQKLQG

SEQ ID NO: 327 - protein, 17 aa, Artificial Sequence
  CDR-H2
YISSSSSTIYYADSVKG

SEQ ID NO: 328 - protein, 16 aa, Artificial Sequence
  CDR-H2
YIYYSGSTNYNPSLKS

SEQ ID NO: 329 - protein, 17 aa, Artificial Sequence
  CDR-H2
IIYPGDSDTRYSPSFQG

SEQ ID NO: 330 - protein, 16 aa, Artificial Sequence
  CDR-H2
VIYSGGSTYYADSVKG

SEQ ID NO: 331 - protein, 16 aa, Artificial Sequence
  CDR-H2
SIYYSGSTYYNPSLKS

SEQ ID NO: 332 - protein, 16 aa, Artificial Sequence
  CDR-H2
YIYYSGSTYYNPSLKS

SEQ ID NO: 333 - protein, 16 aa, Artificial Sequence
  CDR-H2
YIHFSGSTHYHPSLKS

SEQ ID NO: 334 - protein, 16 aa, Artificial Sequence
  CDR-H2
LIYWNDDKRYSPSLKS

SEQ ID NO: 335 - protein, 17 aa, Artificial Sequence
  CDR-H2
RINSDGSSTSYADSVKG

SEQ ID NO: 336 - protein, 16 aa, Artificial Sequence
  CDR-H2
AIGTAGDTYYPGSVKG

SEQ ID NO: 337 - protein, 17 aa, Artificial Sequence
  CDR-H2
WINAGNGNTKYSQKFQG

SEQ ID NO: 338 - protein, 17 aa, Artificial Sequence
  CDR-H2
AISGSGGSTYYADSVKG

SEQ ID NO: 339 - protein, 17 aa, Artificial Sequence
  CDR-H2
WINTNTGNPTYAQGFTG

SEQ ID NO: 340 - protein, 17 aa, Artificial Sequence
  CDR-H2
YISSSGSTIYYADSVKG

SEQ ID NO: 341 - protein, 18 aa, Artificial Sequence
  CDR-H2
RTYYRSKWYNDYAVSVKS

SEQ ID NO: 342 - protein, 17 aa, Artificial Sequence
  CDR-H2
LVDPEDGETIYAEKFQG

SEQ ID NO: 343 - protein, 17 aa, Artificial Sequence
  CDR-H2
WMNPNSGNTGYAQKFQG

SEQ ID NO: 344 - protein, 16 aa, Artificial Sequence
  CDR-H2
YIYHSGSTYYNPSLKS

SEQ ID NO: 345 - protein, 11 aa, Artificial Sequence
  CDR-H2
ERVSQRGAFDI

SEQ ID NO: 346 - protein, 10 aa, Artificial Sequence
  CDR-H2
GNPDKDPFDY

SEQ ID NO: 347 - protein, 11 aa, Artificial Sequence
  CDR-H2
DFYCTNWYFDL

SEQ ID NO: 348 - protein, 12 aa, Artificial Sequence
  CDR-H2
ESSSGSYWYFDL

SEQ ID NO: 349 - protein, 17 aa, Artificial Sequence
  CDR-H2
DSGYKYNLYYYYYYMDV

SEQ ID NO: 350 - protein, 13 aa, Artificial Sequence
  CDR-H2
GGDLSHYYYYMDV

SEQ ID NO: 351 - protein, 13 aa, Artificial Sequence
  CDR-H2
ENRRYNSCYYFDY

SEQ ID NO: 352 - protein, 13 aa, Artificial Sequence
  CDR-H2
GGDLSHYYYYLDV

SEQ ID NO: 353 - protein, 13 aa, Artificial Sequence
  CDR-H2
ATLLSLSYDAFDI

SEQ ID NO: 354 - protein, 12 aa, Artificial Sequence
  CDR-H2
GGDLSHYYYMDV

SEQ ID NO: 355 - protein, 8 aa, Artificial Sequence
  CDR-H2
ERDRWFDP

SEQ ID NO: 356 - protein, 11 aa, Artificial Sequence
  CDR-H2
ETPPSLGAFDI

SEQ ID NO: 357 - protein, 14 aa, Artificial Sequence
  CDR-H2
EAYCLSDSYWYFDL

SEQ ID NO: 358 - protein, 14 aa, Artificial Sequence
  CDR-H2
ESWKYFYPRGYMDV

SEQ ID NO: 359 - protein, 11 aa, Artificial Sequence
  CDR-H2
GGVVSHYAMDC

SEQ ID NO: 360 - protein, 9 aa, Artificial Sequence
  CDR-H2
HYYYYYMDV

SEQ ID NO: 361 - protein, 9 aa, Artificial Sequence
  CDR-H2
KTTSFYFDY

SEQ ID NO: 362 - protein, 8 aa, Artificial Sequence
  CDR-H2
HYYYYMDV

SEQ ID NO: 363 - protein, 10 aa, Artificial Sequence
  CDR-H2
GVLLYNWFDP

SEQ ID NO: 364 - protein, 9 aa, Artificial Sequence
  CDR-H2
HYYYYYLDV

SEQ ID NO: 365 - protein, 11 aa, Artificial Sequence
  CDR-H2
DLPGSYWYFDL

SEQ ID NO: 366 - protein, 12 aa, Artificial Sequence
  CDR-H2
EGNGANPDAFDI

SEQ ID NO: 367 - protein, 10 aa, Artificial Sequence
  CDR-H2
RHMRLSCFDY

SEQ ID NO: 368 - protein, 9 aa, Artificial Sequence
  CDR-H2
HYYYYSMDV

SEQ ID NO: 369 - protein, 7 aa, Artificial Sequence
  CDR-H2
SFDWFDP

SEQ ID NO: 370 - protein, 14 aa, Artificial Sequence
  CDR-H2
ERSISPYYYYYMDV

SEQ ID NO: 371 - protein, 10 aa, Artificial Sequence
  CDR-H2
DSVIWYWFDP

SEQ ID NO: 372 - protein, 15 aa, Artificial Sequence
  CDR-H2
EEILPRLSYYYYMDV

SEQ ID NO: 373 - protein, 12 aa, Artificial Sequence
  CDR-H2
GGRAHSSWYFDL

SEQ ID NO: 374 - protein, 17 aa, Artificial Sequence
  CDR-H3
DRIKILPRLGYYYYMDV

SEQ ID NO: 375 - protein, 12 aa, Artificial Sequence
  CDR-H3
DTVIHYYYYMDV

SEQ ID NO: 376 - protein, 16 aa, Artificial Sequence
  CDR-H3
DVIVEVFLSYYYYMDV

SEQ ID NO: 377 - protein, 12 aa, Artificial Sequence
  CDR-H3
DIFIHYYYYMDV

SEQ ID NO: 378 - protein, 14 aa, Artificial Sequence
  CDR-H3
DGTFYSYSPYYFDY

SEQ ID NO: 379 - protein, 17 aa, Artificial Sequence
  CDR-H3
EWIKILPRLGYYYYMDV

SEQ ID NO: 380 - protein, 12 aa, Artificial Sequence
  CDR-H3
DRSLYYYYYMDV

SEQ ID NO: 381 - protein, 14 aa, Artificial Sequence
  CDR-H3
DKILAPNYYYYMDV

SEQ ID NO: 382 - protein, 16 aa, Artificial Sequence
  CDR-H3
EKSWKYFYYYYYYMDV

SEQ ID NO: 383 - protein, 15 aa, Artificial Sequence
  CDR-H3
ENTSTIPYYYYYMDV

SEQ ID NO: 384 - protein, 19 aa, Artificial Sequence
  CDR-H3
EDVDKNTSTIYYYYYYMDV

SEQ ID NO: 385 - protein, 17 aa, Artificial Sequence
  CDR-H3
DGGDIVSSSAIYWYFDL

SEQ ID NO: 386 - protein, 14 aa, Artificial Sequence
  CDR-H3
DLILPPYYYYYMDV

SEQ ID NO: 387 - protein, 19 aa, Artificial Sequence
  CDR-H3
ETWIKILPRYYYYYYYMDV

SEQ ID NO: 388 - protein, 12 aa, Artificial Sequence
  CDR-H3
DLSRYYYYYMDV

SEQ ID NO: 389 - protein, 9 aa, Artificial Sequence
  CDR-H3
EHIVLCFDY

SEQ ID NO: 390 - protein, 15 aa, Artificial Sequence
  CDR-H3
DKILPRPYYYYYMDV

SEQ ID NO: 391 - protein, 8 aa, Artificial Sequence
  CDR-H3
GSNEYFQH

SEQ ID NO: 392 - protein, 9 aa, Artificial Sequence
  CDR-H3
GTSYWYFDL

SEQ ID NO: 393 - protein, 14 aa, Artificial Sequence
  CDR-H3
EEIVEVFYYYYMDV

SEQ ID NO: 394 - protein, 8 aa, Artificial Sequence
  CDR-H3
VDDYYFDY

SEQ ID NO: 395 - protein, 14 aa, Artificial Sequence
  CDR-H3
STNILLSYTKAFDI

SEQ ID NO: 396 - protein, 12 aa, Artificial Sequence
  CDR-H3
DKTYYYYYYMDV

SEQ ID NO: 397 - protein, 19 aa, Artificial Sequence
  CDR-H3
EKYFHDKYFHDYYYYYMDV

SEQ ID NO: 398 - protein, 12 aa, Artificial Sequence
  CDR-H3
DTSVYYYYYMDV

SEQ ID NO: 399 - protein, 14 aa, Artificial Sequence
  CDR-H3
EKILPYYYYYYMDV

SEQ ID NO: 400 - protein, 21 aa, Artificial Sequence
  CDR-H3
QWIYIYINPRGFIFLHDAFDI

SEQ ID NO: 401 - protein, 12 aa, Artificial Sequence
  CDR-H3
EDVDFHHDAFDI

SEQ ID NO: 402 - protein, 19 aa, Artificial Sequence
  CDR-H3
EGVDKNTSTIYYYYYYMDV

SEQ ID NO: 403 - protein, 8 aa, Artificial Sequence
  CDR-H3
DRRGYFDL

SEQ ID NO: 404 - protein, 15 aa, Artificial Sequence
  CDR-H3
GIHVDIRSMEDWFDP

SEQ ID NO: 405 - protein, 12 aa, Artificial Sequence
  CDR-H3
DIGTSYYYYMDV

SEQ ID NO: 406 - protein, 15 aa, Artificial Sequence
  CDR-H3
EVVEVFLYYYYYMDV

SEQ ID NO: 407 - protein, 12 aa, Artificial Sequence
  CDR-H3
DLYYYYYYYMDV

SEQ ID NO: 408 - protein, 22 aa, Artificial Sequence
  CDR-H3
ESWKYFYPRGSIFIHYYYYMDV

SEQ ID NO: 409 - protein, 14 aa, Artificial Sequence
  CDR-H3
DRIVEVFYYYYMDV

SEQ ID NO: 410 - protein, 16 aa, Artificial Sequence
  CDR-H3
EKYFHDWLYYYYYMDV

SEQ ID NO: 411 - protein, 16 aa, Artificial Sequence
  CDR-H3
DLVDKNTSYYYYYMDV

SEQ ID NO: 412 - protein, 8 aa, Artificial Sequence
  CDR-H3
VQNEYFQH

SEQ ID NO: 413 - protein, 6 aa, Artificial Sequence
  CDR-H3
ANWFDP

SEQ ID NO: 414 - protein, 12 aa, Artificial Sequence
  CDR-H3
GGWTAWYYYMDV

SEQ ID NO: 415 - protein, 8 aa, Artificial Sequence
  CDR-H3
AKYYYMDV

SEQ ID NO: 416 - protein, 14 aa, Artificial Sequence
  CDR-H3
DQVDKNTYYYYMDV

SEQ ID NO: 417 - protein, 10 aa, Artificial Sequence
  CDR-H3
ACQLAEYFQH

SEQ ID NO: 418 - protein, 14 aa, Artificial Sequence
  CDR-H3
DRVDKNTSYYYMDV

SEQ ID NO: 419 - protein, 12 aa, Artificial Sequence
  CDR-H3
RVQLKLVHWFDP

SEQ ID NO: 420 - protein, 12 aa, Artificial Sequence
  CDR-H3
YYDYVTVFYFQH

SEQ ID NO: 421 - protein, 11 aa, Artificial Sequence
  CDR-H3
ESYPSFYAFDI

SEQ ID NO: 422 - protein, 15 aa, Artificial Sequence
  CDR-H3
SNMWSYSLNDYYFDY

SEQ ID NO: 423 - protein, 6 aa, Unknown
  immunoreceptor tyrosine-based inhibitory motif
  SITE (1)..(1): Xaa is Ser, Ile, Val or Leu
  SITE (2)..(2): Xaa is any amino acid
  SITE (4)..(5): Xaa is any amino acid
  SITE (6)..(6): Xaa is Ile, Val or Leu
XXYXXX

SEQ ID NO: 424 - protein, 64 aa, Artificial Sequence
  Hinge (iTIM hinge)
YGSQSSKPYLLTHPSDPLELVVSGPSGGPSSPTTGPTSTSGPEDQPLTPTGSDPQSGLGRHLGV

SEQ ID NO: 425 - protein, 44 aa, Artificial Sequence
  Short hinge 2
VVSGPSGGPSSPTTGPTSTSGPEDQPLTPTGSDPQSGLGRHLGV

SEQ ID NO: 426 - protein, 67 aa, Artificial Sequence
  Long hinge 1
AGSGGSGGSGGSPVPSTPPTPSPSTPPTPSPSGGSGNSSGSGGSPVPSTPPTPSPSTPPTPSPSASV

SEQ ID NO: 427 - protein, 75 aa, Artificial Sequence
  Long hinge 2
AGSGGSGGSGGSPVPSTPPTNSSSTPPTPSPSPVPSTPPTNSSSTPPTPSPSPVPSTPPTNSSSTPPTPSPSASV

SEQ ID NO: 428 - protein, 85 aa, Artificial Sequence
  2x short hinge
VVSGPSGGPSSPTTGPTSTSGPEDQPLTPTGSDPQSGLGRHVVSGPSGGPSSPTTGPTSTSGPEDQPLTPTGSDPQSGLGRHLGV

SEQ ID NO: 429 - protein, 32 aa, Artificial Sequence
  Hinge (truncated)
TTGPTSTSGPEDQPLTPTGSDPQSGLGRHLGV

SEQ ID NO: 430 - protein, 18 aa, Artificial Sequence
  T2A self-cleaving peptide
EGRGSLLTCGDVEENPGP

SEQ ID NO: 431 - protein, 19 aa, Artificial Sequence
  P2A self-cleaving peptide
ATNFSLLKQAGDVEENPGP

SEQ ID NO: 432 - protein, 20 aa, Artificial Sequence
  E2A self-cleaving peptide
QCTNYALLKLAGDVESNPGP

SEQ ID NO: 433 - protein, 22 aa, Artificial Sequence
  F2A self-cleaving peptide
VKQTLNFDLLKLAGDVESNPGP

SEQ ID NO: 434 - DNA, 63 bp, Unknown
  encodes T2A self-cleaving peptide
ggatccggagagggcagaggcagcctgctgacatgtggcgacgtggaagagaaccctggcccc

SEQ ID NO: 435 - DNA, 83 bp, Unknown
  encodes scaffold sequence
gttttagagctagaaatagcaagttaaaataaggctagtccgttatcaacttgaaaaagtggcaccgagtcggtgcttttttt

SEQ ID NO: 436 - DNA, 20 bp, Artificial Sequence
  Guide Nucleic Acid Targeting Sequence
tggacgacacgcagttcgtg

SEQ ID NO: 437 - DNA, 20 bp, Artificial Sequence
  Guide Nucleic Acid Targeting Sequence
cagatacctggagaacggga

SEQ ID NO: 438 - DNA, 20 bp, Artificial Sequence
  Guide Nucleic Acid Targeting Sequence
tcccgttctccaggtatctg

SEQ ID NO: 439 - DNA, 20 bp, Artificial Sequence
  Guide Nucleic Acid Targeting Sequence
ccgccgcggtccaagagcgc

SEQ ID NO: 440 - DNA, 20 bp, Artificial Sequence
  Guide Nucleic Acid Targeting Sequence
cctgcgctcttggaccgcgg

SEQ ID NO: 441 - DNA, 21 bp, Artificial Sequence
  Guide Nucleic Acid Targeting Sequence
ggacctgcgctcttggaccgc

SEQ ID NO: 442 - DNA, 23 bp, Artificial Sequence
  Guide Nucleic Acid Targeting Sequence
aaggagacgctgcagcgcacggg

SEQ ID NO: 443 - DNA, 23 bp, Artificial Sequence
  Guide Nucleic Acid Targeting Sequence
gaaggagacgctgcagcgcacgg

SEQ ID NO: 444 - DNA, 23 bp, Artificial Sequence
  Guide Nucleic Acid Targeting Sequence
gcgggcgccgtggatagagcagg

SEQ ID NO: 445 - DNA, 23 bp, Artificial Sequence
  Guide Nucleic Acid Targeting Sequence
tgctctatccacggcgcccgcgg

SEQ ID NO: 446 - DNA, 23 bp, Artificial Sequence
  Guide Nucleic Acid Targeting Sequence
cgatgaagcggggctccccgcgg

SEQ ID NO: 447 - DNA, 23 bp, Artificial Sequence
  Guide Nucleic Acid Targeting Sequence
cgtgtcccggcccggccgcgggg

SEQ ID NO: 448 - DNA, 23 bp, Artificial Sequence
  Guide Nucleic Acid Targeting Sequence
cggctccatcctctggctcgcgg

SEQ ID NO: 449 - DNA, 23 bp, Artificial Sequence
  Guide Nucleic Acid Targeting Sequence
gatgtaatccttgccgtcgtagg

SEQ ID NO: 450 - DNA, 23 bp, Artificial Sequence
  Guide Nucleic Acid Targeting Sequence
acagcgacgccgcgagccagagg

SEQ ID NO: 451 - DNA, 23 bp, Artificial Sequence
  Guide Nucleic Acid Targeting Sequence
ggatggagccgcgggcgccgtgg

SEQ ID NO: 452 - DNA, 23 bp, Artificial Sequence
  Guide Nucleic Acid Targeting Sequence
ggcgccgtggatagagcaggagg

SEQ ID NO: 453 - DNA, 23 bp, Artificial Sequence
  Guide Nucleic Acid Targeting Sequence
gcgccgtggatagagcaggaggg

SEQ ID NO: 454 - DNA, 23 bp, Artificial Sequence
  Guide Nucleic Acid Targeting Sequence
cggctactacaaccagagcgagg

SEQ ID NO: 455 - DNA, 23 bp, Artificial Sequence
  Guide Nucleic Acid Targeting Sequence
ctggttgtagtagccgcgcaggg

SEQ ID NO: 456 - DNA, 23 bp, Artificial Sequence
  Guide Nucleic Acid Targeting Sequence
tactacaaccagagcgaggccgg

SEQ ID NO: 457 - DNA, 23 bp, Artificial Sequence
  Guide Nucleic Acid Targeting Sequence
ctacctggagggcacgtgcgtgg

SEQ ID NO: 458 - DNA, 23 bp, Artificial Sequence
  Guide Nucleic Acid Targeting Sequence
cacgcacgtgccctccaggtagg

SEQ ID NO: 459 - DNA, 23 bp, Artificial Sequence
  Guide Nucleic Acid Targeting Sequence
gcagggtccccaggtccactcgg

SEQ ID NO: 460 - DNA, 23 bp, Artificial Sequence
  Guide Nucleic Acid Targeting Sequence
gtggacctggggaccctgcgcgg

SEQ ID NO: 461 - DNA, 23 bp, Artificial Sequence
  Guide Nucleic Acid Targeting Sequence
tggagggcacgtgcgtggagtgg

SEQ ID NO: 462 - DNA, 23 bp, Artificial Sequence
  Guide Nucleic Acid Targeting Sequence
gtatggctgcgacgtggggtcgg

SEQ ID NO: 463 - DNA, 23 bp, Artificial Sequence
  Guide Nucleic Acid Targeting Sequence
ctgagctgccatgtccgccgcgg

SEQ ID NO: 464 - DNA, 23 bp, Artificial Sequence
  Guide Nucleic Acid Targeting Sequence
ggattacatcgccctgaaagagg

SEQ ID NO: 465 - DNA, 23 bp, Artificial Sequence
  Guide Nucleic Acid Targeting Sequence
caagtgggaggcggcccatgtgg

SEQ ID NO: 466 - DNA, 23 bp, Artificial Sequence
  Guide Nucleic Acid Targeting Sequence
gtgggaggcggcccatgtggcgg

SEQ ID NO: 467 - DNA, 23 bp, Artificial Sequence
  Guide Nucleic Acid Targeting Sequence
cagttgagagcctacctggaggg

SEQ ID NO: 468 - DNA, 23 bp, Artificial Sequence
  Guide Nucleic Acid Targeting Sequence
gcagttgagagcctacctggagg

SEQ ID NO: 469 - DNA, 23 bp, Artificial Sequence
  Guide Nucleic Acid Targeting Sequence
taccaccagtacgcctacgacgg

SEQ ID NO: 470 - DNA, 23 bp, Artificial Sequence
  Guide Nucleic Acid Targeting Sequence
tgccgtcgtaggcgtactggtgg

SEQ ID NO: 471 - DNA, 23 bp, Artificial Sequence
  Guide Nucleic Acid Targeting Sequence
ccagtacgcctacgacggcaagg

SEQ ID NO: 472 - DNA, 23 bp, Artificial Sequence
  Guide Nucleic Acid Targeting Sequence
ggatgtgaagaaatacctcatgg

SEQ ID NO: 473 - DNA, 23 bp, Artificial Sequence
  Guide Nucleic Acid Targeting Sequence
atttcttcacatccgtgtcccgg

SEQ ID NO: 474 - DNA, 23 bp, Artificial Sequence
  Guide Nucleic Acid Targeting Sequence
aggcgtactggtggtacccgcgg

SEQ ID NO: 475 - DNA, 23 bp, Artificial Sequence
  Guide Nucleic Acid Targeting Sequence
cgtactggtggtacccgcggagg

SEQ ID NO: 476 - DNA, 23 bp, Artificial Sequence
  Guide Nucleic Acid Targeting Sequence
gaggatgtatggctgcgacgtgg

SEQ ID NO: 477 - DNA, 23 bp, Artificial Sequence
  Guide Nucleic Acid Targeting Sequence
ggatgtatggctgcgacgtgggg

SEQ ID NO: 478 - DNA, 23 bp, Artificial Sequence
  Guide Nucleic Acid Targeting Sequence
ctcagaccaccaagcacaagtgg

SEQ ID NO: 479 - DNA, 23 bp, Artificial Sequence
  Guide Nucleic Acid Targeting Sequence
tcagaccaccaagcacaagtggg

SEQ ID NO: 480 - DNA, 23 bp, Artificial Sequence
  Guide Nucleic Acid Targeting Sequence
caccaagcacaagtgggaggcgg

SEQ ID NO: 481 - DNA, 23 bp, Artificial Sequence
  Guide Nucleic Acid Targeting Sequence
gaccaccaagcacaagtgggagg

SEQ ID NO: 482 - DNA, 23 bp, Artificial Sequence
  Guide Nucleic Acid Targeting Sequence
gagccccgcttcatcgcagtggg

SEQ ID NO: 483 - DNA, 23 bp, Artificial Sequence
  Guide Nucleic Acid Targeting Sequence
gtagcccactgcgatgaagcggg

SEQ ID NO: 484 - DNA, 23 bp, Artificial Sequence
  Guide Nucleic Acid Targeting Sequence
tagcccactgcgatgaagcgggg

SEQ ID NO: 485 - DNA, 23 bp, Artificial Sequence
  Guide Nucleic Acid Targeting Sequence
cgtagcccactgcgatgaagcgg

SEQ ID NO: 486 - DNA, 23 bp, Artificial Sequence
  Guide Nucleic Acid Targeting Sequence
cttcatcgcagtgggctacgtgg

SEQ ID NO: 487 - DNA, 23 bp, Artificial Sequence
  Guide Nucleic Acid Targeting Sequence
ggagccccgcttcatcgcagtgg

SEQ ID NO: 488 - DNA, 23 bp, Artificial Sequence
  Guide Nucleic Acid Targeting Sequence
cggggagacacggaaagtgaagg

SEQ ID NO: 489 - DNA, 23 bp, Artificial Sequence
  Guide Nucleic Acid Targeting Sequence
agtattgggacggggagacacgg

SEQ ID NO: 490 - DNA, 23 bp, Artificial Sequence
  Guide Nucleic Acid Targeting Sequence
agggtccggagtattgggacggg

SEQ ID NO: 491 - DNA, 23 bp, Artificial Sequence
  Guide Nucleic Acid Targeting Sequence
gagggtccggagtattgggacgg

SEQ ID NO: 492 - DNA, 23 bp, Artificial Sequence
  Guide Nucleic Acid Targeting Sequence
ggaccctcctgctctatccacgg

SEQ ID NO: 493 - DNA, 23 bp, Artificial Sequence
  Guide Nucleic Acid Targeting Sequence
gtggatagagcaggagggtccgg

SEQ ID NO: 494 - DNA, 23 bp, Artificial Sequence
  Guide Nucleic Acid Targeting Sequence
agactcaccgagtggacctgggg

SEQ ID NO: 495 - DNA, 23 bp, Artificial Sequence
  Guide Nucleic Acid Targeting Sequence
cactcggtgagtctgtgagtggg

SEQ ID NO: 496 - DNA, 23 bp, Artificial Sequence
  Guide Nucleic Acid Targeting Sequence
cagactcaccgagtggacctggg

SEQ ID NO: 497 - DNA, 23 bp, Artificial Sequence
  Guide Nucleic Acid Targeting Sequence
ccactcacagactcaccgagtgg

SEQ ID NO: 498 - DNA, 23 bp, Artificial Sequence
  Guide Nucleic Acid Targeting Sequence
ccactcggtgagtctgtgagtgg

SEQ ID NO: 499 - DNA, 23 bp, Artificial Sequence
  Guide Nucleic Acid Targeting Sequence
tcggactggcgcttcctccgcgg

SEQ ID NO: 500 - DNA, 23 bp, Artificial Sequence
  Guide Nucleic Acid Targeting Sequence
gcagccatacatcctctggacgg

SEQ ID NO: 501 - DNA, 23 bp, Artificial Sequence
  Guide Nucleic Acid Targeting Sequence
tctcaactgctccgccacatggg

SEQ ID NO: 502 - DNA, 23 bp, Artificial Sequence
  Guide Nucleic Acid Targeting Sequence
accctcatgctgcacatggcagg

SEQ ID NO: 503 - DNA, 23 bp, Artificial Sequence
  Guide Nucleic Acid Targeting Sequence
acctgccatgtgcagcatgaggg

SEQ ID NO: 504 - DNA, 23 bp, Artificial Sequence
  Guide Nucleic Acid Targeting Sequence
cacctgccatgtgcagcatgagg

SEQ ID NO: 505 - DNA, 23 bp, Artificial Sequence
  Guide Nucleic Acid Targeting Sequence
ggaggaccagacccaggacacgg

SEQ ID NO: 506 - DNA, 23 bp, Artificial Sequence
  Guide Nucleic Acid Targeting Sequence
ggatggggaggaccagacccagg

SEQ ID NO: 507 - DNA, 23 bp, Artificial Sequence
  Guide Nucleic Acid Targeting Sequence
gacctggcagcgggatggggagg

SEQ ID NO: 508 - DNA, 23 bp, Artificial Sequence
  Guide Nucleic Acid Targeting Sequence
agatcacactgacctggcagcgg

SEQ ID NO: 509 - DNA, 23 bp, Artificial Sequence
  Guide Nucleic Acid Targeting Sequence
gatcacactgacctggcagcggg

SEQ ID NO: 510 - DNA, 23 bp, Artificial Sequence
  Guide Nucleic Acid Targeting Sequence
aggtcagtgtgatctccgcaggg

SEQ ID NO: 511 - DNA, 23 bp, Artificial Sequence
  Guide Nucleic Acid Targeting Sequence
aagcccctcaccctgagatgggg

SEQ ID NO: 512 - DNA, 23 bp, Artificial Sequence
  Guide Nucleic Acid Targeting Sequence
ctgcggagatcacactgacctgg

SEQ ID NO: 513 - DNA, 23 bp, Artificial Sequence
  Guide Nucleic Acid Targeting Sequence
cagcaatgatgcccacgatgggg

SEQ ID NO: 514 - DNA, 23 bp, Artificial Sequence
  Guide Nucleic Acid Targeting Sequence
ccagcaatgatgcccacgatggg

SEQ ID NO: 515 - DNA, 23 bp, Artificial Sequence
  Guide Nucleic Acid Targeting Sequence
gccagcaatgatgcccacgatgg

SEQ ID NO: 516 - DNA, 23 bp, Artificial Sequence
  Guide Nucleic Acid Targeting Sequence
ggatggaaccttccagaagtggg

SEQ ID NO: 517 - DNA, 23 bp, Artificial Sequence
  Guide Nucleic Acid Targeting Sequence
gggatggaaccttccagaagtgg

SEQ ID NO: 518 - DNA, 23 bp, Artificial Sequence
  Guide Nucleic Acid Targeting Sequence
atgcccacgatggggatggtggg

SEQ ID NO: 519 - DNA, 23 bp, Artificial Sequence
  Guide Nucleic Acid Targeting Sequence
cagcccaccatccccatcgtggg

SEQ ID NO: 520 - DNA, 23 bp, Artificial Sequence
  Guide Nucleic Acid Targeting Sequence
ccagcccaccatccccatcgtgg

SEQ ID NO: 521 - DNA, 23 bp, Artificial Sequence
  Guide Nucleic Acid Targeting Sequence
gatgcccacgatggggatggtgg

SEQ ID NO: 522 - DNA, 23 bp, Artificial Sequence
  Guide Nucleic Acid Targeting Sequence
cagggcccagcacctcagggtgg

SEQ ID NO: 523 - DNA, 23 bp, Artificial Sequence
  Guide Nucleic Acid Targeting Sequence
aatgatgcccacgatggggatgg

SEQ ID NO: 524 - DNA, 23 bp, Artificial Sequence
  Guide Nucleic Acid Targeting Sequence
ggccctgacccagacctgggcgg

SEQ ID NO: 525 - DNA, 23 bp, Artificial Sequence
  Guide Nucleic Acid Targeting Sequence
gacccaggacacggagctcgtgg

SEQ ID NO: 526 - DNA, 23 bp, Artificial Sequence
  Guide Nucleic Acid Targeting Sequence
acacggagctcgtggagaccagg

SEQ ID NO: 527 - DNA, 23 bp, Artificial Sequence
  Guide Nucleic Acid Targeting Sequence
cgtggagaccaggcctgcagggg

SEQ ID NO: 528 - DNA, 23 bp, Artificial Sequence
  Guide Nucleic Acid Targeting Sequence
tcgtggagaccaggcctgcaggg

SEQ ID NO: 529 - DNA, 23 bp, Artificial Sequence
  Guide Nucleic Acid Targeting Sequence
agctgtgatcactggagctgtgg

SEQ ID NO: 530 - DNA, 23 bp, Artificial Sequence
  Guide Nucleic Acid Targeting Sequence
aaaaggagggagctactctcagg

SEQ ID NO: 531 - DNA, 23 bp, Artificial Sequence
  Guide Nucleic Acid Targeting Sequence
atgtggaggaggaagagctcagg

SEQ ID NO: 532 - DNA, 23 bp, Artificial Sequence
  Guide Nucleic Acid Targeting Sequence
gtgtctctcacagcttgtaaagg

SEQ ID NO: 533 - DNA, 23 bp, Artificial Sequence
  Guide Nucleic Acid Targeting Sequence
gagagacacatcagagccctggg

SEQ ID NO: 534 - DNA, 23 bp, Artificial Sequence
  Guide Nucleic Acid Targeting Sequence
ctccgcagggtagaagctcaggg

SEQ ID NO: 535 - DNA, 23 bp, Artificial Sequence
  Guide Nucleic Acid Targeting Sequence
ggccctgagcttctaccctgcgg

SEQ ID NO: 536 - DNA, 23 bp, Artificial Sequence
  Guide Nucleic Acid Targeting Sequence
gctcagggcccagcacctcaggg

SEQ ID NO: 537 - DNA, 23 bp, Artificial Sequence
  Guide Nucleic Acid Targeting Sequence
tatctctgctcctgtccagaagg

SEQ ID NO: 538 - DNA, 23 bp, Artificial Sequence
  Guide Nucleic Acid Targeting Sequence
agtagcaggacgagggttcgggg

SEQ ID NO: 539 - DNA, 23 bp, Artificial Sequence
  Guide Nucleic Acid Targeting Sequence
ccccgagagtagcaggacgaggg

SEQ ID NO: 540 - DNA, 23 bp, Artificial Sequence
  Guide Nucleic Acid Targeting Sequence
ccctcgtcctgctactctcgggg

SEQ ID NO: 541 - DNA, 23 bp, Artificial Sequence
  Guide Nucleic Acid Targeting Sequence
cctcgtcctgctactctcggggg

SEQ ID NO: 542 - DNA, 23 bp, Artificial Sequence
  Guide Nucleic Acid Targeting Sequence
ctgtggtcgctgctgtgatgtgg

SEQ ID NO: 543 - DNA, 23 bp, Artificial Sequence
  Guide Nucleic Acid Targeting Sequence
tcgctgctgtgatgtggaggagg

SEQ ID NO: 544 - DNA, 23 bp, Artificial Sequence
  Guide Nucleic Acid Targeting Sequence
tggtcgctgctgtgatgtggagg

SEQ ID NO: 545 - DNA, 23 bp, Artificial Sequence
  Guide Nucleic Acid Targeting Sequence
cacagccgcccacttctggaagg

SEQ ID NO: 546 - DNA, 23 bp, Artificial Sequence
  Guide Nucleic Acid Targeting Sequence
ccagaagtgggcggctgtggtgg

SEQ ID NO: 547 - DNA, 23 bp, Artificial Sequence
  Guide Nucleic Acid Targeting Sequence
tggaaccttccagaagtgggcgg

SEQ ID NO: 548 - DNA, 23 bp, Artificial Sequence
  Guide Nucleic Acid Targeting Sequence
tcacagctccaaagagaaccagg

SEQ ID NO: 549 - DNA, 23 bp, Artificial Sequence
  Guide Nucleic Acid Targeting Sequence
ctgaccatgaagccaccctgagg

SEQ ID NO: 550 - DNA, 23 bp, Artificial Sequence
  Guide Nucleic Acid Targeting Sequence
gcaaaccctcatgctgcacatgg

SEQ ID NO: 551 - DNA, 23 bp, Artificial Sequence
  Guide Nucleic Acid Targeting Sequence
tgaagccaccctgaggtgctggg

SEQ ID NO: 552 - DNA, 23 bp, Artificial Sequence
  Guide Nucleic Acid Targeting Sequence
ggtgagtcatatgcgttttgggg

SEQ ID NO: 553 - DNA, 23 bp, Artificial Sequence
  Guide Nucleic Acid Targeting Sequence
gtgagtcatatgcgttttggggg

SEQ ID NO: 554 - DNA, 23 bp, Artificial Sequence
  Guide Nucleic Acid Targeting Sequence
cttcatggtcagagacagcgtgg

SEQ ID NO: 555 - DNA, 23 bp, Artificial Sequence
  Guide Nucleic Acid Targeting Sequence
tctggccctgacccagacctggg

SEQ ID NO: 556 - DNA, 20 bp, Artificial Sequence
  B2M targeting sequence
cgcgagcacagctaaggcca

SEQ ID NO: 557 - DNA, 20 bp, Artificial Sequence
  B2M targeting sequence
gagtagcgcgagcacagcta

SEQ ID NO: 558 - DNA, 20 bp, Artificial Sequence
  B2M targeting sequence
agggtaggagagactcacgc

SEQ ID NO: 559 - DNA, 20 bp, Artificial Sequence
  B2M targeting sequence
ctgaatctttggagtacctg

SEQ ID NO: 560 - DNA, 20 bp, Artificial Sequence
  B2M targeting sequence
tcacgtcatccagcagagaa

SEQ ID NO: 561 - DNA, 20 bp, Artificial Sequence
  B2M targeting sequence
tcctgaattgctatgtgtct

SEQ ID NO: 562 - DNA, 20 bp, Artificial Sequence
  B2M targeting sequence
aagtcaacttcaatgtcgga

SEQ ID NO: 563 - DNA, 20 bp, Artificial Sequence
  B2M targeting sequence
gtcttttcccgatattcctc

SEQ ID NO: 564 - DNA, 20 bp, Artificial Sequence
  B2M targeting sequence
tggagtacctgaggaatatc

SEQ ID NO: 565 - DNA, 20 bp, Artificial Sequence
  B2M targeting sequence
cagcccaagatagttaagtg

SEQ ID NO: 566 - DNA, 20 bp, Artificial Sequence
  B2M targeting sequence
acaaagtcacatggttcaca

SEQ ID NO: 567 - DNA, 20 bp, Artificial Sequence
  B2M targeting sequence
actctctctttctggcctgg

SEQ ID NO: 568 - DNA, 20 bp, Artificial Sequence
  B2M targeting sequence
tgggctgtgacaaagtcaca

SEQ ID NO: 569 - DNA, 20 bp, Artificial Sequence
  B2M targeting sequence
ggccgagatgtctcgctccg

SEQ ID NO: 570 - DNA, 20 bp, Artificial Sequence
  B2M targeting sequence
cagtaagtcaacttcaatgt

SEQ ID NO: 571 - DNA, 20 bp, Artificial Sequence
  B2M targeting sequence
actcacgctggatagcctcc

SEQ ID NO: 572 - DNA, 20 bp, Artificial Sequence
  B2M targeting sequence
catactcatctttttcagtg

SEQ ID NO: 573 - DNA, 20 bp, Artificial Sequence
  B2M targeting sequence
cacagcccaagatagttaag

SEQ ID NO: 574 - DNA, 20 bp, Artificial Sequence
  B2M targeting sequence
ttcagacttgtctttcagca

SEQ ID NO: 575 - DNA, 20 bp, Artificial Sequence
  B2M targeting sequence
agtcacatggttcacacggc

SEQ ID NO: 576 - DNA, 20 bp, Artificial Sequence
  B2M targeting sequence
atactcatctttttcagtgg

SEQ ID NO: 577 - DNA, 20 bp, Artificial Sequence
  B2M targeting sequence
ggcatactcatctttttcag

SEQ ID NO: 578 - DNA, 20 bp, Artificial Sequence
  B2M targeting sequence
acagcccaagatagttaagt

SEQ ID NO: 579 - DNA, 20 bp, Artificial Sequence
  B2M targeting sequence
gctactctctctttctggcc

SEQ ID NO: 580 - DNA, 20 bp, Artificial Sequence
  B2M targeting sequence
tggagagagaattgaaaaag

SEQ ID NO: 581 - DNA, 20 bp, Artificial Sequence
  B2M targeting sequence
acttgtctttcagcaaggac

SEQ ID NO: 582 - DNA, 20 bp, Artificial Sequence
  B2M targeting sequence
gaagttgacttactgaagaa

SEQ ID NO: 583 - DNA, 20 bp, Artificial Sequence
  B2M targeting sequence
ggccacggagcgagacatct

SEQ ID NO: 584 - DNA, 20 bp, Artificial Sequence
  B2M targeting sequence
gcatactcatctttttcagt

SEQ ID NO: 585 - DNA, 20 bp, Artificial Sequence
  B2M targeting sequence
cgtgagtaaacctgaatctt

SEQ ID NO: 586 - DNA, 20 bp, Artificial Sequence
  B2M targeting sequence
ttaccccacttaactatctt

SEQ ID NO: 587 - DNA, 20 bp, Artificial Sequence
  B2M targeting sequence
ttggagtacctgaggaatat

SEQ ID NO: 588 - DNA, 20 bp, Artificial Sequence
  B2M targeting sequence
acccagacacatagcaattc

SEQ ID NO: 589 - DNA, 20 bp, Artificial Sequence
  B2M targeting sequence
tttgactttccattctctgc

SEQ ID NO: 590 - DNA, 20 bp, Artificial Sequence
  B2M targeting sequence
ttcctgaattgctatgtgtc

SEQ ID NO: 591 - DNA, 20 bp, Artificial Sequence
  B2M targeting sequence
ctcaggtactccaaagattc

SEQ ID NO: 592 - DNA, 20 bp, Artificial Sequence
  B2M targeting sequence
cttaccccacttaactatct

SEQ ID NO: 593 - DNA, 20 bp, Artificial Sequence
  B2M targeting sequence
ctcgcgctactctctctttc

SEQ ID NO: 594 - DNA, 20 bp, Artificial Sequence
  B2M targeting sequence
tcgatctatgaaaaagacag

SEQ ID NO: 595 - DNA, 20 bp, Artificial Sequence
  B2M targeting sequence
gagacatgtaagcagcatca

SEQ ID NO: 596 - DNA, 20 bp, Artificial Sequence
  B2M targeting sequence
acatgtaagcagcatcatgg

SEQ ID NO: 597 - DNA, 20 bp, Artificial Sequence
  B2M targeting sequence
gaagtcctagaatgagcgcc

SEQ ID NO: 598 - DNA, 20 bp, Artificial Sequence
  B2M targeting sequence
gagcgcccggtgtcccaagc

SEQ ID NO: 599 - DNA, 20 bp, Artificial Sequence
  B2M targeting sequence
agcgcccggtgtcccaagct

SEQ ID NO: 600 - DNA, 20 bp, Artificial Sequence
  B2M targeting sequence
gcgcccggtgtcccaagctg

SEQ ID NO: 601 - DNA, 20 bp, Artificial Sequence
  B2M targeting sequence
ctggggcgcgcaccccagat

SEQ ID NO: 602 - DNA, 20 bp, Artificial Sequence
  B2M targeting sequence
gggcgcgcaccccagatcgg

SEQ ID NO: 603 - DNA, 20 bp, Artificial Sequence
  B2M targeting sequence
ggcgcgcaccccagatcgga

SEQ ID NO: 604 - DNA, 20 bp, Artificial Sequence
  B2M targeting sequence
catcacgagactctaagaaa

SEQ ID NO: 605 - DNA, 20 bp, Artificial Sequence
  B2M targeting sequence
taagaaaaggaaactgaaaa

SEQ ID NO: 606 - DNA, 20 bp, Artificial Sequence
  B2M targeting sequence
aagaaaaggaaactgaaaac

SEQ ID NO: 607 - DNA, 20 bp, Artificial Sequence
  B2M targeting sequence
gaaagtccctctctctaacc

SEQ ID NO: 608 - DNA, 20 bp, Artificial Sequence
  B2M targeting sequence
ctaacctggcactgcgtcgc

SEQ ID NO: 609 - DNA, 20 bp, Artificial Sequence
  B2M targeting sequence
ctggcactgcgtcgctggct

SEQ ID NO: 610 - DNA, 20 bp, Artificial Sequence
  B2M targeting sequence
tgcgtcgctggcttggagac

SEQ ID NO: 611 - DNA, 20 bp, Artificial Sequence
  B2M targeting sequence
gctggcttggagacaggtga

SEQ ID NO: 612 - DNA, 20 bp, Artificial Sequence
  B2M targeting sequence
gagacaggtgacggtccctg

SEQ ID NO: 613 - DNA, 20 bp, Artificial Sequence
  B2M targeting sequence
agacaggtgacggtccctgc

SEQ ID NO: 614 - DNA, 20 bp, Artificial Sequence
  B2M targeting sequence
cctgcgggccttgtcctgat

SEQ ID NO: 615 - DNA, 20 bp, Artificial Sequence
  B2M targeting sequence
cgggccttgtcctgattggc

SEQ ID NO: 616 - DNA, 20 bp, Artificial Sequence
  B2M targeting sequence
gggccttgtcctgattggct

SEQ ID NO: 617 - DNA, 20 bp, Artificial Sequence
  B2M targeting sequence
gggcacgcgtttaatataag

SEQ ID NO: 618 - DNA, 20 bp, Artificial Sequence
  B2M targeting sequence
cacgcgtttaatataagtgg

SEQ ID NO: 619 - DNA, 20 bp, Artificial Sequence
  B2M targeting sequence
tataagtggaggcgtcgcgc

SEQ ID NO: 620 - DNA, 20 bp, Artificial Sequence
  B2M targeting sequence
aagtggaggcgtcgcgctgg

SEQ ID NO: 621 - DNA, 20 bp, Artificial Sequence
  B2M targeting sequence
agtggaggcgtcgcgctggc

SEQ ID NO: 622 - DNA, 20 bp, Artificial Sequence
  B2M targeting sequence
ttcctgaagctgacagcatt

SEQ ID NO: 623 - DNA, 20 bp, Artificial Sequence
  B2M targeting sequence
tcctgaagctgacagcattc

SEQ ID NO: 624 - DNA, 20 bp, Artificial Sequence
  B2M targeting sequence
gcccgaatgctgtcagcttc

SEQ ID NO: 625 - DNA, 20 bp, Artificial Sequence
  B2M targeting sequence
aaacgcgtgcccagccaatc

SEQ ID NO: 626 - DNA, 20 bp, Artificial Sequence
  B2M targeting sequence
gtgcccagccaatcaggaca

SEQ ID NO: 627 - DNA, 20 bp, Artificial Sequence
  B2M targeting sequence
ccaatcaggacaaggcccgc

SEQ ID NO: 628 - DNA, 20 bp, Artificial Sequence
  B2M targeting sequence
caatcaggacaaggcccgca

SEQ ID NO: 629 - DNA, 20 bp, Artificial Sequence
  B2M targeting sequence
caagccagcgacgcagtgcc

SEQ ID NO: 630 - DNA, 20 bp, Artificial Sequence
  B2M targeting sequence
cgcagtgccaggttagagag

SEQ ID NO: 631 - DNA, 20 bp, Artificial Sequence
  B2M targeting sequence
gcagtgccaggttagagaga

SEQ ID NO: 632 - DNA, 20 bp, Artificial Sequence
  B2M targeting sequence
gagtctcgtgatgtttaaga

SEQ ID NO: 633 - DNA, 20 bp, Artificial Sequence
  B2M targeting sequence
taagaaggcatgcactagac

SEQ ID NO: 634 - DNA, 20 bp, Artificial Sequence
  B2M targeting sequence
aagaaggcatgcactagact

SEQ ID NO: 635 - DNA, 20 bp, Artificial Sequence
  B2M targeting sequence
tgagtttgctgtctgtacat

SEQ ID NO: 636 - DNA, 20 bp, Artificial Sequence
  B2M targeting sequence
tacatcggcgccctccgatc

SEQ ID NO: 637 - DNA, 20 bp, Artificial Sequence
  B2M targeting sequence
acatcggcgccctccgatct

SEQ ID NO: 638 - DNA, 20 bp, Artificial Sequence
  B2M targeting sequence
catcggcgccctccgatctg

SEQ ID NO: 639 - DNA, 20 bp, Artificial Sequence
  B2M targeting sequence
ctggggtgcgcgccccagct

SEQ ID NO: 640 - DNA, 20 bp, Artificial Sequence
  B2M targeting sequence
tggggtgcgcgccccagctt

SEQ ID NO: 641 - DNA, 20 bp, Artificial Sequence
  B2M targeting sequence
cgcgccccagcttgggacac

SEQ ID NO: 642 - DNA, 20 bp, Artificial Sequence
  B2M targeting sequence
gcgccccagcttgggacacc

SEQ ID NO: 643 - DNA, 20 bp, Artificial Sequence
  B2M targeting sequence
caagtcacttagcatctctg

SEQ ID NO: 644 - DNA, 20 bp, Artificial Sequence
  B2M targeting sequence
acagaagttctccttctgct

SEQ ID NO: 645 - DNA, 20 bp, Artificial Sequence
  B2M targeting sequence
attcaaagatcttaatcttc

SEQ ID NO: 646 - DNA, 20 bp, Artificial Sequence
  B2M targeting sequence
ttcaaagatcttaatcttct

SEQ ID NO: 647 - DNA, 20 bp, Artificial Sequence
  B2M targeting sequence
ttttctcgaatgaaaaatgc

SEQ ID NO: 648 - DNA, 20 bp, Artificial Sequence
  B2M targeting sequence
tgcaggtccgagcagttaac

SEQ ID NO: 649 - DNA, 20 bp, Artificial Sequence
  B2M targeting sequence
ggtccgagcagttaactggc

SEQ ID NO: 650 - DNA, 20 bp, Artificial Sequence
  B2M targeting sequence
gtccgagcagttaactggct

SEQ ID NO: 651 - DNA, 20 bp, Artificial Sequence
  B2M targeting sequence
tccgagcagttaactggctg

SEQ ID NO: 652 - DNA, 20 bp, Artificial Sequence
  B2M targeting sequence
agcaagtcacttagcatctc

SEQ ID NO: 653 - DNA, 20 bp, Artificial Sequence
  B2M targeting sequence
gcaagtcacttagcatctct

SEQ ID NO: 654 - DNA, 20 bp, Artificial Sequence
  B2M targeting sequence
tggggccagtctgcaaagcg

SEQ ID NO: 655 - DNA, 20 bp, Artificial Sequence
  B2M targeting sequence
ggggccagtctgcaaagcga

SEQ ID NO: 656 - DNA, 20 bp, Artificial Sequence
  B2M targeting sequence
gggccagtctgcaaagcgag

SEQ ID NO: 657 - DNA, 20 bp, Artificial Sequence
  B2M targeting sequence
ggccagtctgcaaagcgagg

SEQ ID NO: 658 - DNA, 20 bp, Artificial Sequence
  B2M targeting sequence
ggacaccgggcgctcattct

SEQ ID NO: 659 - DNA, 20 bp, Artificial Sequence
  B2M targeting sequence
ggcgctcattctaggacttc

SEQ ID NO: 660 - DNA, 20 bp, Artificial Sequence
  B2M targeting sequence
ctcattctaggacttcaggc

SEQ ID NO: 661 - DNA, 20 bp, Artificial Sequence
  B2M targeting sequence
attctaggacttcaggctgg

SEQ ID NO: 662 - DNA, 20 bp, Artificial Sequence
  B2M targeting sequence
ttcaggctggaggcacatta

SEQ ID NO: 663 - DNA, 20 bp, Artificial Sequence
  B2M targeting sequence
tgccccctcgctttgcagac

SEQ ID NO: 664 - DNA, 20 bp, Artificial Sequence
  B2M targeting sequence
gatgctaagtgacttgctaa

SEQ ID NO: 665 - DNA, 20 bp, Artificial Sequence
  B2M targeting sequence
gccccagccagttaactgct

SEQ ID NO: 666 - DNA, 20 bp, Artificial Sequence
  B2M targeting sequence
gcatttttcattcgagaaaa

SEQ ID NO: 667 - DNA, 20 bp, Artificial Sequence
  B2M targeting sequence
tttgaatgctacctagcaga

SEQ ID NO: 668 - DNA, 20 bp, Artificial Sequence
  B2M targeting sequence
ttctgtttataactacagct

SEQ ID NO: 669 - DNA, 20 bp, Artificial Sequence
  B2M targeting sequence
tctgtttataactacagctt

SEQ ID NO: 670 - DNA, 21 bp, Artificial Sequence
  target B2M sequences complement
agagaatggaaagtcaaattt

SEQ ID NO: 671 - DNA, 21 bp, Artificial Sequence
  target B2M sequences complement
atggacatgatcttctttata

SEQ ID NO: 672 - DNA, 21 bp, Artificial Sequence
  target B2M sequences complement
tggacatgatcttctttataa

SEQ ID NO: 673 - DNA, 21 bp, Artificial Sequence
  target B2M sequences complement
ggacatgatcttctttataat

SEQ ID NO: 674 - DNA, 21 bp, Artificial Sequence
  target B2M sequences complement
tgacaggattattggaaattt

SEQ ID NO: 675 - DNA, 21 bp, Artificial Sequence
  target B2M sequences complement
ttgtggttaatctggtttatt

SEQ ID NO: 676 - DNA, 21 bp, Artificial Sequence
  target B2M sequences complement
tgtggttaatctggtttattt

SEQ ID NO: 677 - DNA, 21 bp, Artificial Sequence
  target B2M sequences complement
gcagagaatggaaagtcaaat

SEQ ID NO: 678 - DNA, 21 bp, Artificial Sequence
  target B2M sequences complement
cagagaatggaaagtcaaatt

SEQ ID NO: 679 - DNA, 21 bp, Artificial Sequence
  target B2M sequences complement
gagaatggaaagtcaaatttc

SEQ ID NO: 680 - DNA, 21 bp, Artificial Sequence
  target B2M sequences complement
gtcacagcccaagatagttaa

SEQ ID NO: 681 - DNA, 21 bp, Artificial Sequence
  target B2M sequences complement
tgcttatacacttacacttta

SEQ ID NO: 682 - DNA, 21 bp, Artificial Sequence
  target B2M sequences complement
gcttatacacttacactttat

SEQ ID NO: 683 - DNA, 21 bp, Artificial Sequence
  target B2M sequences complement
cttatacacttacactttatg

SEQ ID NO: 684 - DNA, 21 bp, Artificial Sequence
  target B2M sequences complement
acatggacatgatcttcttta

SEQ ID NO: 685 - DNA, 21 bp, Artificial Sequence
  target B2M sequences complement
catggacatgatcttctttat

SEQ ID NO: 686 - DNA, 21 bp, Artificial Sequence
  target B2M sequences complement
atcaacatcttggtcagattt

SEQ ID NO: 687 - DNA, 21 bp, Artificial Sequence
  target B2M sequences complement
cttgcactcaaagcttgttaa

SEQ ID NO: 688 - DNA, 21 bp, Artificial Sequence
  target B2M sequences complement
agttaagcgtgcataagttaa

SEQ ID NO: 689 - DNA, 21 bp, Artificial Sequence
  target B2M sequences complement
gcataagttaacttccaattt

SEQ ID NO: 690 - DNA, 21 bp, Artificial Sequence
  target B2M sequences complement
tacatactctgcttagaattt

SEQ ID NO: 691 - DNA, 21 bp, Artificial Sequence
  target B2M sequences complement
acatactctgcttagaatttg

SEQ ID NO: 692 - DNA, 21 bp, Artificial Sequence
  target B2M sequences complement
ttgacaggattattggaaatt

SEQ ID NO: 693 - DNA, 21 bp, Artificial Sequence
  target B2M sequences complement
gacaggattattggaaatttg

SEQ ID NO: 694 - DNA, 21 bp, Artificial Sequence
  target B2M sequences complement
taaggcatggttgtggttaat

SEQ ID NO: 695 - DNA, 21 bp, Artificial Sequence
  target B2M sequences complement
gttgtggttaatctggtttat

SEQ ID NO: 696 - DNA, 21 bp, Artificial Sequence
  target B2M sequences complement
gttccacaagttaaataaatc

SEQ ID NO: 697 - DNA, 21 bp, Artificial Sequence
  target B2M sequences complement
tccagcgtactccaaagattc

SEQ ID NO: 698 - DNA, 21 bp, Artificial Sequence
  target B2M sequences complement
tactccaaagattcaggttta

SEQ ID NO: 699 - DNA, 21 bp, Artificial Sequence
  target B2M sequences complement
actccaaagattcaggtttac

SEQ ID NO: 700 - DNA, 21 bp, Artificial Sequence
  target B2M sequences complement
cacgtcatccagcagagaatg

SEQ ID NO: 701 - DNA, 21 bp, Artificial Sequence
  target B2M sequences complement
ggtttcatccatccgacattg

SEQ ID NO: 702 - DNA, 21 bp, Artificial Sequence
  target B2M sequences complement
ccgacattgaagttgacttac

SEQ ID NO: 703 - DNA, 21 bp, Artificial Sequence
  target B2M sequences complement
tgaagaatggagagagaattg

SEQ ID NO: 704 - DNA, 21 bp, Artificial Sequence
  target B2M sequences complement
gagcattcagacttgtctttc

SEQ ID NO: 705 - DNA, 21 bp, Artificial Sequence
  target B2M sequences complement
ttcagcaaggactggtctttc

SEQ ID NO: 706 - DNA, 21 bp, Artificial Sequence
  target B2M sequences complement
gcaaggactggtctttctatc

SEQ ID NO: 707 - DNA, 21 bp, Artificial Sequence
  target B2M sequences complement
cgtgtgaaccatgtgactttg

SEQ ID NO: 708 - DNA, 21 bp, Artificial Sequence
  target B2M sequences complement
ctttgtcacagcccaagatag

SEQ ID NO: 709 - DNA, 21 bp, Artificial Sequence
  target B2M sequences complement
tcacagcccaagatagttaag

SEQ ID NO: 710 - DNA, 21 bp, Artificial Sequence
  target B2M sequences complement
agtgggatcgagacatgtaag

SEQ ID NO: 711 - DNA, 21 bp, Artificial Sequence
  target B2M sequences complement
aggtttgaagatgccgcattt

SEQ ID NO: 712 - DNA, 21 bp, Artificial Sequence
  target B2M sequences complement
ggtttgaagatgccgcatttg

SEQ ID NO: 713 - DNA, 21 bp, Artificial Sequence
  target B2M sequences complement
ttgatatgcttatacacttac

SEQ ID NO: 714 - DNA, 21 bp, Artificial Sequence
  target B2M sequences complement
tgagtgctgtctccatgtttg

SEQ ID NO: 715 - DNA, 21 bp, Artificial Sequence
  target B2M sequences complement
tgtctccatgtttgatgtatc

SEQ ID NO: 716 - DNA, 21 bp, Artificial Sequence
  target B2M sequences complement
tcaacatcttggtcagatttg

SEQ ID NO: 717 - DNA, 21 bp, Artificial Sequence
  target B2M sequences complement
tcagatttgaactcttcaatc

SEQ ID NO: 718 - DNA, 21 bp, Artificial Sequence
  target B2M sequences complement
ttcaatctcttgcactcaaag

SEQ ID NO: 719 - DNA, 21 bp, Artificial Sequence
  target B2M sequences complement
ttgcactcaaagcttgttaag

SEQ ID NO: 720 - DNA, 21 bp, Artificial Sequence
  target B2M sequences complement
actcaaagcttgttaagatag

SEQ ID NO: 721 - DNA, 21 bp, Artificial Sequence
  target B2M sequences complement
agatagttaagcgtgcataag

SEQ ID NO: 722 - DNA, 21 bp, Artificial Sequence
  target B2M sequences complement
tgcataagttaacttccaatt

SEQ ID NO: 723 - DNA, 21 bp, Artificial Sequence
  target B2M sequences complement
gttaacttccaatttacatac

SEQ ID NO: 724 - DNA, 21 bp, Artificial Sequence
  target B2M sequences complement
attgacaggattattggaaat

SEQ ID NO: 725 - DNA, 21 bp, Artificial Sequence
  target B2M sequences complement
gtaaggcatggttgtggttaa

SEQ ID NO: 726 - DNA, 21 bp, Artificial Sequence
  target B2M sequences complement
ggttgtggttaatctggttta

SEQ ID NO: 727 - DNA, 21 bp, Artificial Sequence
  target B2M sequences complement
ttcctgaagctgacagcattc

SEQ ID NO: 728 - DNA, 21 bp, Artificial Sequence
  target B2M sequences complement
gctatccagcgtactccaaag

SEQ ID NO: 729 - DNA, 21 bp, Artificial Sequence
  target B2M sequences complement
catccagcagagaatggaaag

SEQ ID NO: 730 - DNA, 21 bp, Artificial Sequence
  target B2M sequences complement
caaatttcctgaattgctatg

SEQ ID NO: 731 - DNA, 21 bp, Artificial Sequence
  target B2M sequences complement
attgctatgtgtctgggtttc

SEQ ID NO: 732 - DNA, 21 bp, Artificial Sequence
  target B2M sequences complement
gaagatgccgcatttggattg

SEQ ID NO: 733 - DNA, 21 bp, Artificial Sequence
  target B2M sequences complement
caatttacatactctgcttag

SEQ ID NO: 734 - DNA, 21 bp, Artificial Sequence
  target B2M sequences complement
tatccagcgtactccaaagat

SEQ ID NO: 735 - DNA, 21 bp, Artificial Sequence
  target B2M sequences complement
atccagcgtactccaaagatt

SEQ ID NO: 736 - DNA, 21 bp, Artificial Sequence
  target B2M sequences complement
ctccaaagattcaggtttact

SEQ ID NO: 737 - DNA, 21 bp, Artificial Sequence
  target B2M sequences complement
tgctatgtgtctgggtttcat

SEQ ID NO: 738 - DNA, 21 bp, Artificial Sequence
  target B2M sequences complement
tttcatccatccgacattgaa

SEQ ID NO: 739 - DNA, 21 bp, Artificial Sequence
  target B2M sequences complement
gaagttgacttactgaagaat

SEQ ID NO: 740 - DNA, 21 bp, Artificial Sequence
  target B2M sequences complement
gaagaatggagagagaattga

SEQ ID NO: 741 - DNA, 21 bp, Artificial Sequence
  target B2M sequences complement
agaatggagagagaattgaaa

SEQ ID NO: 742 - DNA, 21 bp, Artificial Sequence
  target B2M sequences complement
cagcaaggactggtctttcta

SEQ ID NO: 743 - DNA, 21 bp, Artificial Sequence
  target B2M sequences complement
agcaaggactggtctttctat

SEQ ID NO: 744 - DNA, 21 bp, Artificial Sequence
  target B2M sequences complement
actttgtcacagcccaagata

SEQ ID NO: 745 - DNA, 21 bp, Artificial Sequence
  target B2M sequences complement
ttgtcacagcccaagatagtt

SEQ ID NO: 746 - DNA, 21 bp, Artificial Sequence
  target B2M sequences complement
tgtcacagcccaagatagtta

SEQ ID NO: 747 - DNA, 21 bp, Artificial Sequence
  target B2M sequences complement
cacagcccaagatagttaagt

SEQ ID NO: 748 - DNA, 21 bp, Artificial Sequence
  target B2M sequences complement
gcagcatcatggaggtttgaa

SEQ ID NO: 749 - DNA, 21 bp, Artificial Sequence
  target B2M sequences complement
ccgcatttggattggatgaat

SEQ ID NO: 750 - DNA, 21 bp, Artificial Sequence
  target B2M sequences complement
ttgagtgctgtctccatgttt

SEQ ID NO: 751 - DNA, 21 bp, Artificial Sequence
  target B2M sequences complement
agtgctgtctccatgtttgat

SEQ ID NO: 752 - DNA, 21 bp, Artificial Sequence
  target B2M sequences complement
ctgtctccatgtttgatgtat

SEQ ID NO: 753 - DNA, 21 bp, Artificial Sequence
  target B2M sequences complement
tctaggagggctggcaactta

SEQ ID NO: 754 - DNA, 21 bp, Artificial Sequence
  target B2M sequences complement
caacatcttggtcagatttga

SEQ ID NO: 755 - DNA, 21 bp, Artificial Sequence
  target B2M sequences complement
gtcagatttgaactcttcaat

SEQ ID NO: 756 - DNA, 21 bp, Artificial Sequence
  target B2M sequences complement
tcttgcactcaaagcttgtta

SEQ ID NO: 757 - DNA, 21 bp, Artificial Sequence
  target B2M sequences complement
tgcactcaaagcttgttaaga

SEQ ID NO: 758 - DNA, 21 bp, Artificial Sequence
  target B2M sequences complement
gcactcaaagcttgttaagat

SEQ ID NO: 759 - DNA, 21 bp, Artificial Sequence
  target B2M sequences complement
cactcaaagcttgttaagata

SEQ ID NO: 760 - DNA, 21 bp, Artificial Sequence
  target B2M sequences complement
tcaaagcttgttaagatagtt

SEQ ID NO: 761 - DNA, 21 bp, Artificial Sequence
  target B2M sequences complement
caaagcttgttaagatagtta

SEQ ID NO: 762 - DNA, 21 bp, Artificial Sequence
  target B2M sequences complement
gatagttaagcgtgcataagt

SEQ ID NO: 763 - DNA, 21 bp, Artificial Sequence
  target B2M sequences complement
atagttaagcgtgcataagtt

SEQ ID NO: 764 - DNA, 21 bp, Artificial Sequence
  target B2M sequences complement
tagttaagcgtgcataagtta

SEQ ID NO: 765 - DNA, 21 bp, Artificial Sequence
  target B2M sequences complement
ttaagcgtgcataagttaact

SEQ ID NO: 766 - DNA, 21 bp, Artificial Sequence
  target B2M sequences complement
taagcgtgcataagttaactt

SEQ ID NO: 767 - DNA, 21 bp, Artificial Sequence
  target B2M sequences complement
atttacatactctgcttagaa

SEQ ID NO: 768 - DNA, 21 bp, Artificial Sequence
  target B2M sequences complement
tttacatactctgcttagaat

SEQ ID NO: 769 - DNA, 21 bp, Artificial Sequence
  target B2M sequences complement
acaggattattggaaatttgt

SEQ ID NO: 770 - DNA, 21 bp, Artificial Sequence
  target B2M sequences complement
caggattattggaaatttgtt

SEQ ID NO: 771 - DNA, 21 bp, Artificial Sequence
  target B2M sequences complement
aggcatggttgtggttaatct

SEQ ID NO: 772 - DNA, 21 bp, Artificial Sequence
  target B2M sequences complement
cagcagagaatggaaagtcaa

SEQ ID NO: 773 - DNA, 21 bp, Artificial Sequence
  target B2M sequences complement
tccgacattgaagttgactta

SEQ ID NO: 774 - DNA, 21 bp, Artificial Sequence
  target B2M sequences complement
ctggtctttctatctcttgta

SEQ ID NO: 775 - DNA, 21 bp, Artificial Sequence
  target B2M sequences complement
ccgtgtgaaccatgtgacttt

SEQ ID NO: 776 - DNA, 21 bp, Artificial Sequence
  target B2M sequences complement
cccaagatagttaagtgggat

SEQ ID NO: 777 - DNA, 21 bp, Artificial Sequence
  target B2M sequences complement
ggttgctccacaggtagctct

SEQ ID NO: 778 - DNA, 21 bp, Artificial Sequence
  target B2M sequences complement
gctccacaggtagctctagga

SEQ ID NO: 779 - DNA, 21 bp, Artificial Sequence
  target B2M sequences complement
gggagcagagaattctcttat

SEQ ID NO: 780 - DNA, 21 bp, Artificial Sequence
  target B2M sequences complement
ggagcagagaattctcttatc

SEQ ID NO: 781 - DNA, 21 bp, Artificial Sequence
  target B2M sequences complement
gagcagagaattctcttatcc

SEQ ID NO: 782 - DNA, 21 bp, Artificial Sequence
  target B2M sequences complement
gagaattctcttatccaacat

SEQ ID NO: 783 - DNA, 21 bp, Artificial Sequence
  target B2M sequences complement
gaattctcttatccaacatca

SEQ ID NO: 784 - DNA, 21 bp, Artificial Sequence
  target B2M sequences complement
aagtggagcattcagacttgt

SEQ ID NO: 785 - DNA, 21 bp, Artificial Sequence
  target B2M sequences complement
aaggactggtctttctatctc

SEQ ID NO: 786 - DNA, 21 bp, Artificial Sequence
  target B2M sequences complement
aagcttgttaagatagttaag

SEQ ID NO: 787 - DNA, 21 bp, Artificial Sequence
  target B2M sequences complement
aagcgtgcataagttaacttc

SEQ ID NO: 788 - DNA, 21 bp, Artificial Sequence
  target B2M sequences complement
aagatgccgcatttggattgg

SEQ ID NO: 789 - DNA, 21 bp, Artificial Sequence
  target B2M sequences complement
aagaatggagagagaattgaa

SEQ ID NO: 790 - DNA, 21 bp, Artificial Sequence
  target B2M sequences complement
aacatcaacatcttggtcaga

SEQ ID NO: 791 - DNA, 21 bp, Artificial Sequence
  target B2M sequences complement
aaggcatggttgtggttaatc

SEQ ID NO: 792 - DNA, 21 bp, Artificial Sequence
  target B2M sequences complement
aagcagcatcatggaggtttg

SEQ ID NO: 793 - DNA, 21 bp, Artificial Sequence
  target B2M sequences complement
aagatgagtatgcctgccgtg

SEQ ID NO: 794 - DNA, 21 bp, Artificial Sequence
  target B2M sequences complement
aagttgacttactgaagaatg

SEQ ID NO: 795 - DNA, 21 bp, Artificial Sequence
  target B2M sequences complement
aagatagttaagcgtgcataa

SEQ ID NO: 796 - DNA, 21 bp, Artificial Sequence
  target B2M sequences complement
aacttccaatttacatactct

SEQ ID NO: 797 - DNA, 21 bp, Artificial Sequence
  target B2M sequences complement
aacatcttggtcagatttgaa

SEQ ID NO: 798 - DNA, 21 bp, Artificial Sequence
  target B2M sequences complement
aactcttcaatctcttgcact

SEQ ID NO: 799 - DNA, 21 bp, Artificial Sequence
  target B2M sequences complement
aatttcctgaattgctatgtg

SEQ ID NO: 800 - DNA, 21 bp, Artificial Sequence
  target B2M sequences complement
aatggaaagtcaaatttcctg

SEQ ID NO: 801 - DNA, 21 bp, Artificial Sequence
  target B2M sequences complement
aaccatgtgactttgtcacag

SEQ ID NO: 802 - DNA, 21 bp, Artificial Sequence
  target B2M sequences complement
aattgacaggattattggaaa

SEQ ID NO: 803 - DNA, 21 bp, Artificial Sequence
  target B2M sequences complement
aattctcttatccaacatcaa

SEQ ID NO: 804 - DNA, 21 bp, Artificial Sequence
  target B2M sequences complement
aaagtggagcattcagacttg

SEQ ID NO: 805 - DNA, 21 bp, Artificial Sequence
  target B2M sequences complement
aaagtcaaatttcctgaattg

SEQ ID NO: 806 - DNA, 21 bp, Artificial Sequence
  target B2M sequences complement
gttgctccacaggtagctcta

SEQ ID NO: 807 - DNA, 21 bp, Artificial Sequence
  target B2M sequences complement
aatttacatactctgcttaga

SEQ ID NO: 808 - DNA, 46 bp, Artificial Sequence
  B2M shRNA
gttaacttccaatttacataccgaagtatgtaaattggaagttaac

SEQ ID NO: 809 - DNA, 21 bp, Artificial Sequence
  target HLA sequences complement
cttcttccttccctattaaaa

SEQ ID NO: 810 - DNA, 21 bp, Artificial Sequence
  target HLA sequences complement
tctcactccatgaggtatttc

SEQ ID NO: 811 - DNA, 21 bp, Artificial Sequence
  target HLA sequences complement
ctctcactccatgaggtattt

SEQ ID NO: 812 - DNA, 21 bp, Artificial Sequence
  target HLA sequences complement
gaggaggaagagctcagatag

SEQ ID NO: 813 - DNA, 21 bp, Artificial Sequence
  target HLA sequences complement
gctctcactccatgaggtatt

SEQ ID NO: 814 - DNA, 21 bp, Artificial Sequence
  target HLA sequences complement
aggattacatcgccctgaaag

SEQ ID NO: 815 - DNA, 21 bp, Artificial Sequence
  target HLA sequences complement
acaccgtccagaggatgtatg

SEQ ID NO: 816 - DNA, 21 bp, Artificial Sequence
  target HLA sequences complement
agggtccttcttcctggatac

SEQ ID NO: 817 - DNA, 21 bp, Artificial Sequence
  target HLA sequences complement
cctacgacggcaaggattaca

SEQ ID NO: 818 - DNA, 21 bp, Artificial Sequence
  target HLA sequences complement
tcactccatgaggtatttctt

SEQ ID NO: 819 - DNA, 21 bp, Artificial Sequence
  target HLA sequences complement
ctacgacggcaaggattacat

SEQ ID NO: 820 - DNA, 21 bp, Artificial Sequence
  target HLA sequences complement
ctcactccatgaggtatttct

SEQ ID NO: 821 - DNA, 21 bp, Artificial Sequence
  target HLA sequences complement
ggaggaagagctcagatagaa

SEQ ID NO: 822 - DNA, 21 bp, Artificial Sequence
  target HLA sequences complement
cacaccgtccagaggatgtat

SEQ ID NO: 823 - DNA, 21 bp, Artificial Sequence
  target HLA sequences complement
cacgctgtctctgaccatgaa

SEQ ID NO: 824 - DNA, 21 bp, Artificial Sequence
  target HLA sequences complement
ctggacaggagcagagataca

SEQ ID NO: 825 - DNA, 21 bp, Artificial Sequence
  target HLA sequences complement
tggaggaggaagagctcagat

SEQ ID NO: 826 - DNA, 21 bp, Artificial Sequence
  target HLA sequences complement
ggctctcactccatgaggtat

SEQ ID NO: 827 - DNA, 21 bp, Artificial Sequence
  target HLA sequences complement
catctctgtctcaacttcatg

SEQ ID NO: 828 - DNA, 21 bp, Artificial Sequence
  target HLA sequences complement
tacgacggcaaggattacatc

SEQ ID NO: 829 - DNA, 21 bp, Artificial Sequence
  target HLA sequences complement
ggattacatcgccctgaaaga

SEQ ID NO: 830 - DNA, 21 bp, Artificial Sequence
  target HLA sequences complement
gattacatcgccctgaaagag

SEQ ID NO: 831 - DNA, 21 bp, Artificial Sequence
  target HLA sequences complement
ctcagaccaccaagcacaagt

SEQ ID NO: 832 - DNA, 21 bp, Artificial Sequence
  target HLA sequences complement
tcacaccgtccagaggatgta

SEQ ID NO: 833 - DNA, 21 bp, Artificial Sequence
  target HLA sequences complement
actccatgaggtatttcttca

SEQ ID NO: 834 - DNA, 21 bp, Artificial Sequence
  target HLA sequences complement
cactccatgaggtatttcttc

SEQ ID NO: 835 - DNA, 21 bp, Artificial Sequence
  target HLA sequences complement
ccatgaggtatttcttcacat

SEQ ID NO: 836 - DNA, 21 bp, Artificial Sequence
  target HLA sequences complement
acttcttccttccctattaaa

SEQ ID NO: 837 - DNA, 21 bp, Artificial Sequence
  target HLA sequences complement
gtgtctctcacagcttgtaaa

SEQ ID NO: 838 - DNA, 21 bp, Artificial Sequence
  target HLA sequences complement
ctgtgttcgtgtaggcataat

SEQ ID NO: 839 - DNA, 21 bp, Artificial Sequence
  target HLA sequences complement
tgtgttcgtgtaggcataatg

SEQ ID NO: 840 - DNA, 21 bp, Artificial Sequence
  target HLA sequences complement
taacttcttccttccctatta

SEQ ID NO: 841 - DNA, 21 bp, Artificial Sequence
  target HLA sequences complement
tctggacaggagcagagatac

SEQ ID NO: 842 - DNA, 21 bp, Artificial Sequence
  target HLA sequences complement
ttgctggcctggttctctttg

SEQ ID NO: 843 - DNA, 21 bp, Artificial Sequence
  target HLA sequences complement
tgtctctcacagcttgtaaag

SEQ ID NO: 844 - DNA, 21 bp, Artificial Sequence
  target HLA sequences complement
acttgaagaaccctgactttg

SEQ ID NO: 845 - DNA, 21 bp, Artificial Sequence
  target HLA sequences complement
gaagaaccctgactttgtttc

SEQ ID NO: 846 - DNA, 21 bp, Artificial Sequence
  target HLA sequences complement
tctgtgttcgtgtaggcataa

SEQ ID NO: 847 - DNA, 21 bp, Artificial Sequence
  target HLA sequences complement
catggtgcactgagctgtaac

SEQ ID NO: 848 - DNA, 21 bp, Artificial Sequence
  target HLA sequences complement
gtaacttcttccttccctatt

SEQ ID NO: 849 - DNA, 21 bp, Artificial Sequence
  target HLA sequences complement
catgtgcagcatgagggtttg

SEQ ID NO: 850 - DNA, 21 bp, Artificial Sequence
  target HLA sequences complement
ttgttcctgcccttccctttg

SEQ ID NO: 851 - DNA, 21 bp, Artificial Sequence
  target HLA sequences complement
acccagttctcactcccattg

SEQ ID NO: 852 - DNA, 21 bp, Artificial Sequence
  target HLA sequences complement
gggtttccagagaagccaatc

SEQ ID NO: 853 - DNA, 21 bp, Artificial Sequence
  target HLA sequences complement
ttctccctctcccaacctatg

SEQ ID NO: 854 - DNA, 21 bp, Artificial Sequence
  target HLA sequences complement
gtctctcacagcttgtaaagt

SEQ ID NO: 855 - DNA, 21 bp, Artificial Sequence
  target HLA sequences complement
tgtgtctctcacagcttgtaa

SEQ ID NO: 856 - DNA, 21 bp, Artificial Sequence
  target HLA sequences complement
gaggaagagctcagatagaaa

SEQ ID NO: 857 - DNA, 21 bp, Artificial Sequence
  target HLA sequences complement
tgaagaaccctgactttgttt

SEQ ID NO: 858 - DNA, 21 bp, Artificial Sequence
  target HLA sequences complement
ttgaagaaccctgactttgtt

SEQ ID NO: 859 - DNA, 21 bp, Artificial Sequence
  target HLA sequences complement
gtgttcgtgtaggcataatgt

SEQ ID NO: 860 - DNA, 21 bp, Artificial Sequence
  target HLA sequences complement
tggtgcactgagctgtaactt

SEQ ID NO: 861 - DNA, 21 bp, Artificial Sequence
  target HLA sequences complement
ctccctctcccaacctatgta

SEQ ID NO: 862 - DNA, 21 bp, Artificial Sequence
  target HLA sequences complement
aggaggaagagctcagataga

SEQ ID NO: 863 - DNA, 21 bp, Artificial Sequence
  target HLA sequences complement
acctatgtagggtccttcttc

SEQ ID NO: 864 - DNA, 21 bp, Artificial Sequence
  target HLA sequences complement
gggtccttcttcctggatact

SEQ ID NO: 865 - DNA, 21 bp, Artificial Sequence
  target HLA sequences complement
ggtccttcttcctggatactc

SEQ ID NO: 866 - DNA, 21 bp, Artificial Sequence
  target HLA sequences complement
gtccttcttcctggatactca

SEQ ID NO: 867 - DNA, 21 bp, Artificial Sequence
  target HLA sequences complement
aagccaatcagtgtcgtcgcg

SEQ ID NO: 868 - DNA, 21 bp, Artificial Sequence
  target HLA sequences complement
aagaggacctgcgctcttgga

SEQ ID NO: 869 - DNA, 21 bp, Artificial Sequence
  target HLA sequences complement
aagtgtgagacagctgccttg

SEQ ID NO: 870 - DNA, 21 bp, Artificial Sequence
  target HLA sequences complement
aaggcacctgcatgtgtctgt

SEQ ID NO: 871 - DNA, 21 bp, Artificial Sequence
  target HLA sequences complement
aatcatctttcctgttccaga

SEQ ID NO: 872 - DNA, 21 bp, Artificial Sequence
  target HLA sequences complement
aaaggcacctgcatgtgtctg

SEQ ID NO: 873 - DNA, 21 bp, Artificial Sequence
  target HLA sequences complement
aaagaggacctgcgctcttgg

SEQ ID NO: 874 - DNA, 21 bp, Artificial Sequence
  target HLA sequences complement
aaacgcatatgactcaccacg

SEQ ID NO: 875 - DNA, 19 bp, Artificial Sequence
  target HLA sequences complement
ggaagagctcagatagaaa

SEQ ID NO: 876 - DNA, 19 bp, Artificial Sequence
  target HLA sequences complement
gggagacacggaaagtgaa

SEQ ID NO: 877 - DNA, 21 bp, Artificial Sequence
  target HLA sequences complement
cacctgccatgtgcagcatga

SEQ ID NO: 878 - DNA, 21 bp, Artificial Sequence
  target HLA sequences complement
ggagatcacactgacctggca

SEQ ID NO: 879 - DNA, 20 bp, Artificial Sequence
  target HLA sequences complement
ggattacatcgccctgaaag

SEQ ID NO: 880 - DNA, 20 bp, Artificial Sequence
  target HLA sequences complement
gcaggagggtccggagtatt

SEQ ID NO: 881 - DNA, 20 bp, Artificial Sequence
  target HLA sequences complement
ggacggggagacacggaaag

SEQ ID NO: 882 - DNA, 19 bp, Artificial Sequence
  target HLA sequences complement
gaaagtgaaggcccactca

SEQ ID NO: 883 - DNA, 20 bp, Artificial Sequence
  target HLA sequences complement
gatacctggagaacgggaag

SEQ ID NO: 884 - DNA, 20 bp, Artificial Sequence
  target HLA sequences complement
gctgtggtggtgccttctgg

SEQ ID NO: 885 - DNA, 20 bp, Artificial Sequence
  target HLA sequences complement
gctactacaaccagagcgag

SEQ ID NO: 886 - DNA, 19 bp, Artificial Sequence
  target HLA sequences complement
gtggctccgcagatacctg

SEQ ID NO: 887 - DNA, 19 bp, Artificial Sequence
  target HLA sequences complement
gccaatcagtgtcgtcgcg

SEQ ID NO: 888 - DNA, 19 bp, Artificial Sequence
  target HLA sequences complement
gaggacctgcgctcttgga

SEQ ID NO: 889 - DNA, 19 bp, Artificial Sequence
  target HLA sequences complement
gtgtgagacagctgccttg

SEQ ID NO: 890 - DNA, 19 bp, Artificial Sequence
  target HLA sequences complement
ggcacctgcatgtgtctgt

SEQ ID NO: 891 - DNA, 19 bp, Artificial Sequence
  target HLA sequences complement
tcatctttcctgttccaga

SEQ ID NO: 892 - DNA, 19 bp, Artificial Sequence
  target HLA sequences complement
aggcacctgcatgtgtctg

SEQ ID NO: 893 - DNA, 19 bp, Artificial Sequence
  target HLA sequences complement
agaggacctgcgctcttgg

SEQ ID NO: 894 - DNA, 19 bp, Artificial Sequence
  target HLA sequences complement
acgcatatgactcaccacg

SEQ ID NO: 895 - RNA, 2 nt, Artificial Sequence
  5' Flank Sequence
gg

SEQ ID NO: 896 - RNA, 23 nt, Artificial Sequence
  5' Flank Sequence
acaccauguugccagucucuagg

SEQ ID NO: 897 - RNA, 23 nt, Artificial Sequence
  5' Flank Sequence
ugauagcaaugucagcagugccu

SEQ ID NO: 898 - RNA, 23 nt, Artificial Sequence
  5' Flank Sequence
uauugcuguugacagugagcgac

SEQ ID NO: 899 - RNA, 21 nt, Artificial Sequence
  3' Flank Sequence
uggcgucuggcccaaccacac

SEQ ID NO: 900 - RNA, 21 nt, Artificial Sequence
  3' Flank Sequence
guaagguugaccauacucuac

SEQ ID NO: 901 - RNA, 4 nt, Artificial Sequence
  Loop Region Sequence
cgaa

SEQ ID NO: 902 - RNA, 7 nt, Artificial Sequence
  Loop Region Sequence
uucaaga

SEQ ID NO: 903 - RNA, 7 nt, Artificial Sequence
  Loop Region Sequence
auauuca

SEQ ID NO: 904 - RNA, 9 nt, Artificial Sequence
  Loop Region Sequence
ugugcuguc

SEQ ID NO: 905 - RNA, 6 nt, Artificial Sequence
  Loop Region Sequence
cucgag

SEQ ID NO: 906 - RNA, 12 nt, Artificial Sequence
  Loop Region Sequence
cuuccugucaga

SEQ ID NO: 907 - RNA, 15 nt, Artificial Sequence
  Loop Region Sequence
cuucccuuugucaga

SEQ ID NO: 908 - RNA, 12 nt, Artificial Sequence
  Loop Region Sequence
guguuauucuug

SEQ ID NO: 909 - RNA, 12 nt, Artificial Sequence
  Loop Region Sequence
gugucuuaauug

SEQ ID NO: 910 - RNA, 12 nt, Artificial Sequence
  Loop Region Sequence
guguuagucuug

SEQ ID NO: 911 - RNA, 7 nt, Artificial Sequence
  Loop Region Sequence
ucaagag

SEQ ID NO: 912 - RNA, 12 nt, Artificial Sequence
  Loop Region Sequence
ggacauccaggg

SEQ ID NO: 913 - RNA, 15 nt, Artificial Sequence
  Loop Region Sequence
gugaagccacagaug

SEQ ID NO: 914 - RNA, 10 nt, Artificial Sequence
  Loop Region Sequence
gauucuaaaa

SEQ ID NO: 915 - protein, 518 aa, Artificial Sequence
  HLA-A*11 Blocker 4
MDMRVPAQLLGLLLLWLRGARCEVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 916 - DNA, 1554 bp, Artificial Sequence
  HLA-A*11 Blocker 4
atggacatgagggtccccgctcagctcctggggctcctgctactctggctccgaggtgccagatgtgaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgttgtttgggtgttttattatacaactggttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaagtacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccac

SEQ ID NO: 917 - DNA, 66 bp, Artificial Sequence
  signal sequence
atggatatgagagtgcctgcccagctgctcggactgctccttctgtggttgagaggagctcggtgc

SEQ ID NO: 918 - protein, 1210 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIIRNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 919 - protein, 1210 aa, Homo sapiens; identical to SEQ ID NO: 918

What is claimed is:

1. An immune cell comprising:
   (a) an activator receptor comprising an extracellular ligand binding domain specific to an Epidermal Growth Factor Receptor (EGFR) antigen, wherein the extracellular ligand binding domain of the activator receptor comprises an scFv comprising:
      (i) a heavy chain variable region (VH) comprising a complementarity determining region CDR-H1 of SEQ ID NO: 151, a CDR-H2 of SEQ ID NO: 152, and a CDR-H3 of SEQ ID NO: 153; and
      (ii) a light chain variable region (VL) comprising a CDR-L1 of SEQ ID NO: 154, a CDR-L2 of SEQ ID NO: 155, and a CDR-L3 of SEQ ID NO: 156; and
   (b) an inhibitory receptor specific to an HLA-A*02 antigen,
   wherein the immune cell is a T cell.

2. The immune cell of claim 1, wherein the scFv of the activator receptor comprises a sequence having at least 95% identity to the sequence of SEQ ID NO: 18.

3. The immune cell of claim 1, wherein the scFv of the activator receptor comprises the sequence of SEQ ID NO: 18.

4. The immune cell of claim 1, wherein the inhibitory receptor comprises an scFv comprising:
   (i) a VH comprising a CDR-H1 of SEQ ID NO: 104, a CDR-H2 of SEQ ID NO: 105, and a CDR-H3 of SEQ ID NO: 106; and
   (ii) a VL comprising a CDR-L1 of SEQ ID NO: 101, a CDR-L2 of SEQ ID NO: 56, and a CDR-L3 of SEQ ID NO: 103.

5. The immune cell of claim 4, wherein the scFv of the inhibitory receptor comprises a sequence having at least 95% identity to the sequence set forth in SEQ ID NO: 93.

6. The immune cell of claim 4, wherein the scFv of the inhibitory receptor comprises the sequence set forth in SEQ ID NO: 93.

7. The immune cell of claim 1, wherein the activator receptor is a chimeric antigen receptor (CAR) comprising, in N- to C-terminal order:
   (1) a hinge sequence isolated or derived from CD8;
   (2) a transmembrane domain isolated or derived from CD8;
   (3) an intracellular domain isolated or derived from CD28, an intracellular domain isolated or derived from 4-1BB, or both an intracellular domain isolated or derived from CD28 and an intracellular domain isolated or derived from 4-1BB; and
   (4) an intracellular domain isolated or derived from CD3ζ.

8. The immune cell of claim 7, wherein the CAR of the activator receptor comprises the sequence of SEQ ID NO: 177.

9. The immune cell of claim 1, wherein the inhibitory receptor comprises a CAR comprising a LILRB1 intracellular domain, a LILRB1 hinge domain, and a LILRB1 transmembrane domain.

10. The immune cell of claim 9, wherein the CAR of the inhibitory receptor comprises the sequence of SEQ ID NO: 174.

11. The immune cell of claim 1, wherein the immune cell is modified to inactivate, or reduce or eliminate expression or function of an endogenous gene encoding an allele of an endogenous MEW class I polypeptide of the immune cell.

12. The immune cell of claim 11, wherein the gene encoding the MHC class I polypeptide is HLA-A*02.

13. A pharmaceutical composition, comprising a therapeutically effective amount of the immune cells of claim 1 and a pharmaceutically acceptable carrier, diluent or excipient.

14. A method of treating a EGFR+ cancer in a subject identified as having or suspected of having a loss of heterozygosity at an allele encoding a HLA-A*02 antigen in the EGFR+ cancer, comprising administering to the subject the immune cells of claim 1.

15. The method of claim 14, wherein the cancer is small cell lung cancer, non-small cell lung cancer, pancreatic ductal carcinoma, colorectal cancer, head and neck cancer, esophagus and gastric adenocarcinoma, ovarian cancer, glioblastoma multiforme, cervical squamous cell carcinoma, kidney cancer, papillary kidney cancer, kidney renal clear cell carcinoma, bladder cancer, breast cancer, bile duct cancer, liver cancer, prostate cancer, sarcoma, thyroid cancer, thymus cancer, stomach cancer, or uterine cancer.

16. The method of claim 14, wherein the HLA-A*02 antigen is expressed by healthy cells of the subject.

17. The method of claim 14, wherein healthy cells of the subject express both an EGFR antigen and the HLA-A*02 antigen.

18. The method of claim 14, wherein the cancer is small cell lung cancer.

19. The method of claim 14, wherein the cancer is non-small cell lung cancer.

20. The method of claim 14, wherein the inhibitory receptor comprises an scFv comprising:
   (i) a VH comprising a CDR-H1 of SEQ ID NO: 104, a CDR-H2 of SEQ ID NO: 105, and a CDR-H3 of SEQ ID NO: 106; and
   (ii) a VL comprising a CDR-L1 of SEQ ID NO: 101, a CDR-L2 of SEQ ID NO: 56, and a CDR-L3 of SEQ ID NO: 103.

21. A method of selectively killing EGFR+ tumor cells having loss of heterozygosity at an allele encoding an HLA-A*02 antigen in the EGFR+ cancer, comprising contacting the EGFR+ tumor cells with the immune cells of claim 1.

22. The method of claim 21, wherein the tumor cells are in a tissue.

23. The method of claim 21, wherein the tumor cells are in a mixed culture.

24. A kit comprising the immune cell of claim 1.

25. The kit of claim 24, further comprising instructions for use.

26. A polynucleotide system, comprising one or more polynucleotides comprising polynucleotide sequences encoding
   (a) an activator receptor comprising an extracellular ligand binding domain specific to an Epidermal Growth Factor Receptor (EGFR) antigen, wherein the extracellular ligand binding domain of the activator receptor comprises an scFv comprising:
      (i) a heavy chain variable region (VH) comprising a complementarity determining region CDR-H1 of SEQ ID NO: 151, a CDR-H2 of SEQ ID NO: 152, and a CDR-H3 of SEQ ID NO: 153; and
      (ii) a light chain variable region (VL) comprising a CDR-L1 of SEQ ID NO: 154, a CDR-L2 of SEQ ID NO: 155, and a CDR-L3 of SEQ ID NO: 156; and
   (b) an inhibitory receptor specific to an HLA-A*02 antigen.

27. A vector comprising the polynucleotide system of claim 26.

* * * * *